US011447774B2

(12) United States Patent
Qi et al.

(10) Patent No.: US 11,447,774 B2
(45) Date of Patent: Sep. 20, 2022

(54) NUCLEASE SYSTEMS FOR GENETIC ENGINEERING

(71) Applicants: The Board of Trustees of the Leland Stanford Junior University, Stanford, CA (US); Intima Bioscience, Inc., New York, NY (US)

(72) Inventors: Lei S. Qi, Stanford, CA (US); Modassir S. Choudhry, New York, NY (US); Xueqiu Lin, San Bruno, CA (US); Xiaoshu Xu, Millbrae, CA (US)

(73) Assignees: The Board of Trustees of the Leland Stanford Junior University, Stanford, CA (US); Intima Bioscience, Inc., New York, NY (US)

( * ) Notice: Subject to any disclaimer, the term of this patent is extended or adjusted under 35 U.S.C. 154(b) by 0 days.

(21) Appl. No.: 16/809,343

(22) Filed: Mar. 4, 2020

(65) Prior Publication Data

US 2021/0024924 A1    Jan. 28, 2021

Related U.S. Application Data

(63) Continuation of application No. PCT/US2018/050029, filed on Sep. 7, 2018.

(60) Provisional application No. 62/555,564, filed on Sep. 7, 2017, provisional application No. 62/652,047, filed on Apr. 3, 2018.

(51) Int. Cl.
| | | |
|---|---|---|
| *C07H 21/04* | (2006.01) | |
| *C07H 21/02* | (2006.01) | |
| *C12N 15/113* | (2010.01) | |

(52) U.S. Cl.
CPC ...... *C12N 15/113* (2013.01); *C12N 2310/321* (2013.01); *C12N 2310/322* (2013.01)

(58) Field of Classification Search
CPC .......................... C12N 15/113; C12N 2310/20
See application file for complete search history.

(56) References Cited

U.S. PATENT DOCUMENTS

| 10,125,375 | B2 * | 11/2018 | Van Der Oost | ........ | C12N 15/10 |
| 2020/0040334 | A1 | 2/2020 | Shen et al. | | |

FOREIGN PATENT DOCUMENTS

| WO | 2014189628 A1 | 11/2014 | | |
| WO | 2015157534 A1 | 10/2015 | | |
| WO | 2016166268 A1 | 10/2016 | | |
| WO | 2017107898 A2 | 6/2017 | | |
| WO | 2017139264 A1 | 8/2017 | | |
| WO | 2019041344 A1 | 3/2019 | | |
| WO | WO 2019/083532 A1 * | 5/2019 | ........... | C12N 15/113 |

OTHER PUBLICATIONS

International Application No. PCT/US2018/050029, International Preliminary Report on Patentability, dated Mar. 19, 2020, 13 pages.
International Application No. PCT/US2018/050029, International Search Report and Written Opinion, dated Feb. 1, 2019, 18 pages.
Gao et al., DNA-guided genome editing using the Natronobacterium gregoryi Argonaute. Nat Biotechnol 34, 768-773, 2016. https://doi.org/10.1038/nbt.3547.
Hegge et al., Prokaryotic Argonaute proteins: novel genome-editing tools? Nat Rev Microbiol. Jan. 2018; 16(1):5-11; 7 pages.
Hunt, et al., Single-stranded binding proteins and helicase enhance the activity of prokaryotic argonautes in vitro. PLoS One. Aug. 29, 2018; 13(8), e0203073; 20 pages.
Koonin, Evolution of RNA- and DNA-guided antivirus defense systems in prokaryotes and eukaryotes: common ancestry vs convergence. Biol Direct. Feb. 10, 2017; 12(1):5; 14 pages.
Koonin, et al., Mobile Genetic Elements and Evolution of CRISPR-Cas Systems: All the Way There and Back. Genome Biol Evol. Oct. 1, 2017; 9(10):2812-2825.
Lapinaite, et al., Programmable RNA recognition using a CRISPR-associated Argonaute. PNAS. Mar. 2018; 115(13):3368-3373.
Lee, et al., Failure to detect DNA-guided genome editing using Natronobacterium gregoryi Argonaute. Nat Biotechnol. 2016; 35(1):17-18.
Lisitskaya, et al., DNA interference and beyond: structure and functions of prokaryotic Argonaute proteins. Nat Commun. 2018; 9, 5165; 12 pages.
Liu, et al.,Accommodation of Helical Imperfections in Rhodobacter sphaeroides Argonaute Ternary Complexes with Guide RNA and Target DNA. Cell Rep. Jul. 10, 2018; 24(2):453-462.
Liu, et al., Why Is a High Temperature Needed by Thermus thermophilus Argonaute During mRNA Silencing: A Theoretical Study. Front Chem. 2018; 6:223; 14 pages.
Makarova, et al., Prokaryotic homologs of Argonaute proteins are predicted to function as key components of a novel system of defense against mobile genetic elements. Biol Direct. Aug. 25, 2009; 4:29; 15 pages.
Miyoshi, et al., Structural basis for the recognition of guide RNA and target DNA heteroduplex by Argonaute. Nat Commun. Jun. 21, 2016; 7:11846; 12 pages.
O'Green, et al., Unexpected binding behaviors of bacterial Argonautes in human cells cast doubts on their use as targetable gene regulators. PLoS One. Mar. 27, 2018; 13(3):e0193818; 12 pages.
Ryazansky, et al., The Expanded Universe of Prokaryotic Argonaute Proteins. mBio. 2018; 9(6) e01935-18; 20 pages.
Swarts, DNA-guided DNA interference by a prokaryotic Argonaute. Nature. Mar. 13, 2014; 507(7491):258-261.
Swarts, et al., Argonaute of the archaeon Pyrococcus furiosus is a DNA-guided nuclease that targets cognate DNA. Nucleic Acids Res. May 26, 2015; 43(10):5120-9.

(Continued)

*Primary Examiner* — Amy H Bowman
(74) *Attorney, Agent, or Firm* — Kilpatrick Townsend & Stockton LLP

(57) ABSTRACT

Fusion constructs encoding RNase-H-like domain containing compositions are disclosed. Disclosed are also compositions and methods utilizing RNase-H-like domain containing compositions for the treatment of cancer. Also disclosed are the methods of making and using the RNase-H-like domain containing compositions in treating various diseases, conditions, and cancer.

17 Claims, 59 Drawing Sheets

Specification includes a Sequence Listing.

(56) References Cited

OTHER PUBLICATIONS

Swarts, et al., Effects of Argonaute on Gene Expression in Thermus thermophiles. Plos One. 2015; 10(4): e0124880; 13 pages.
Swarts, et al., Autonomous Generation and Loading of DNA Guides by Bacterial Argonaute. Mol Cell. Mar. 16, 2017; 65(6):985-998.
Willkomm, et al., DNA silencing by prokaryotic Argonaute proteins adds a new layer of defense against invading nucleic acids. FEMS Microbiology Reviews. May 2018; 42(3):376-387.
Zander, et al., Guide-independent DNA cleavage by archaeal Argonaute from Methanocaldococcus jannaschii. Nat Microbiol. 2017; 2, 17034; 11 pages.
European Application No. EP18854528.9, "Extended European Search Report," dated May 6, 2021, 9 pages.

* cited by examiner

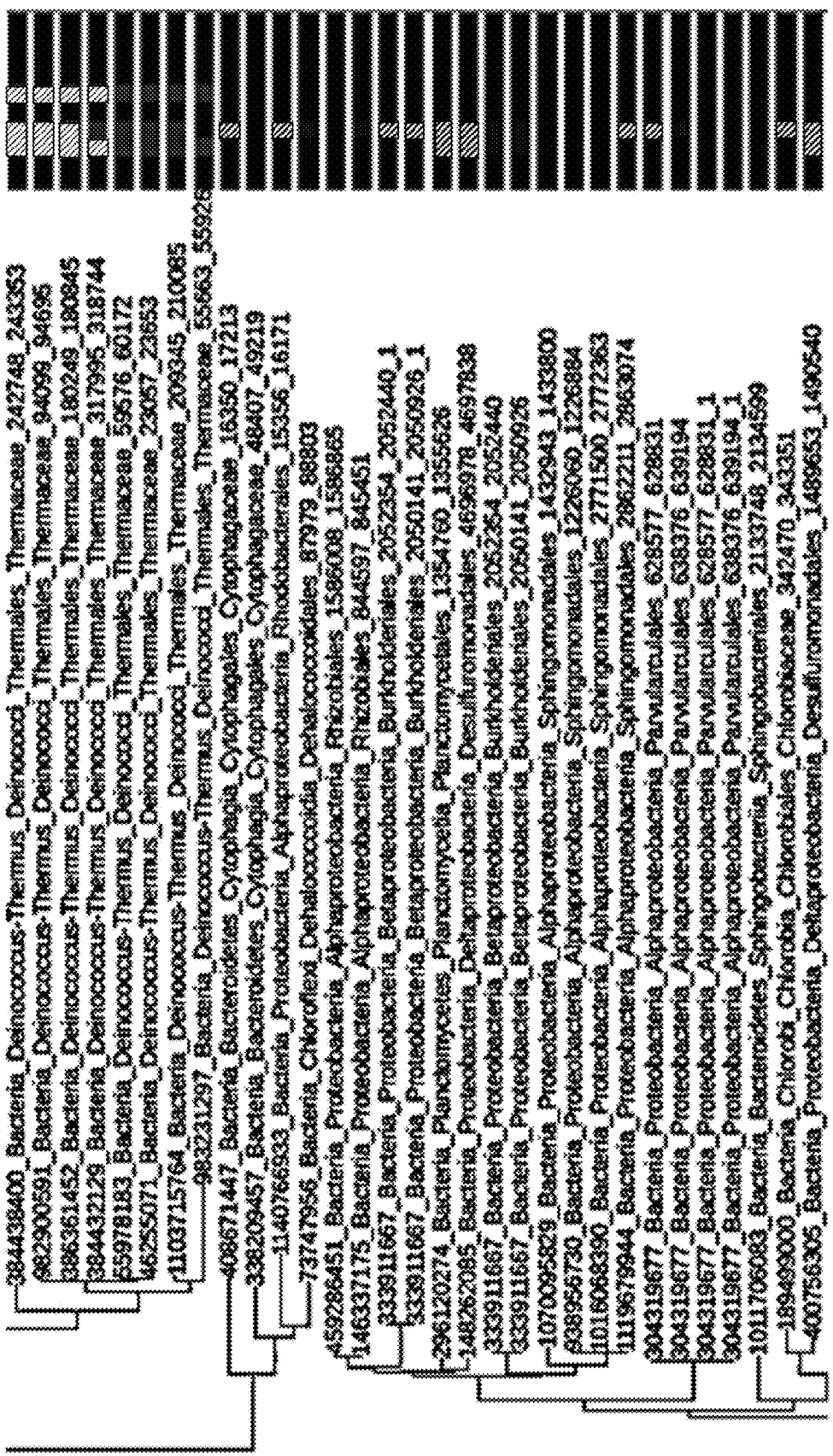
FIG. 7B (cont.d)

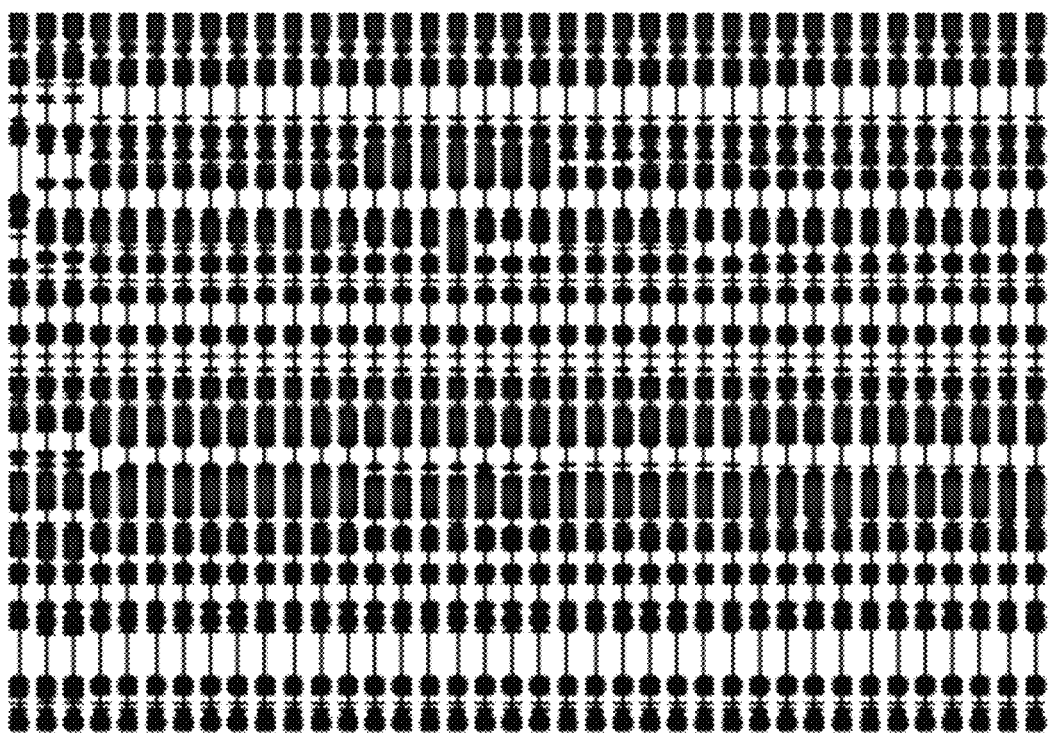
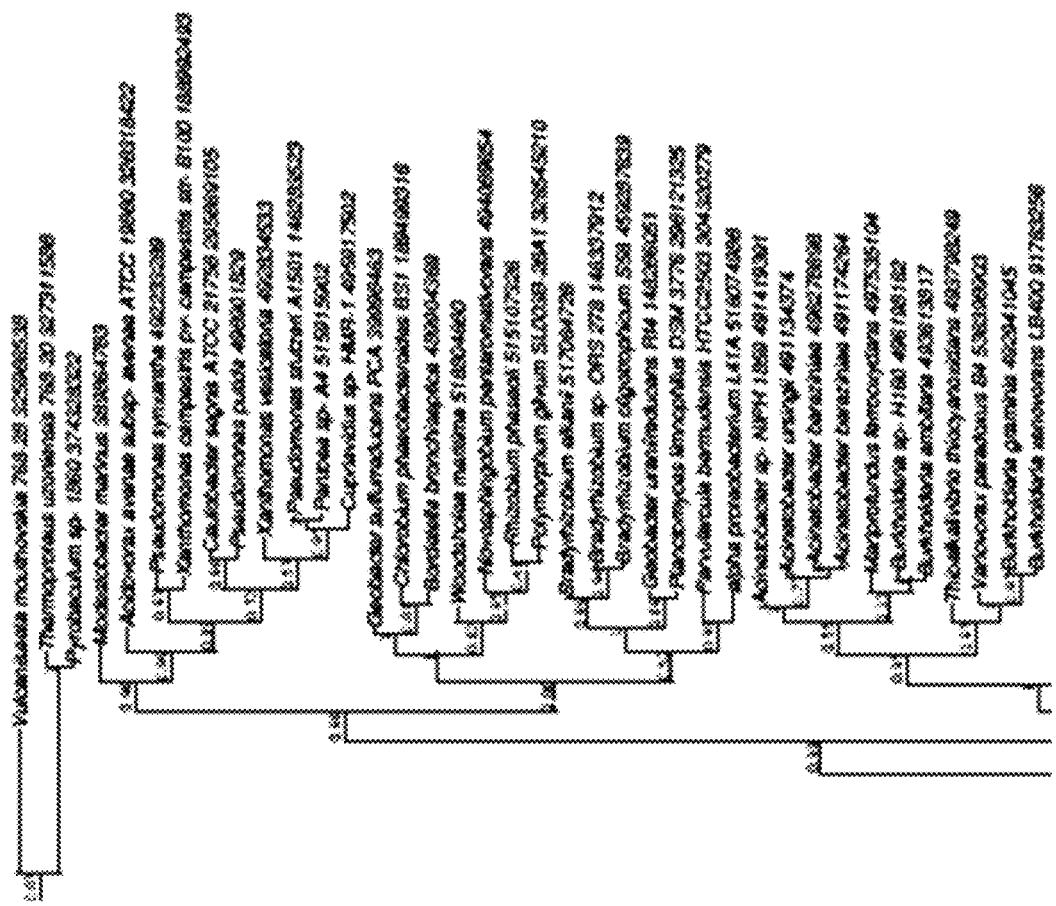
FIG. 8A

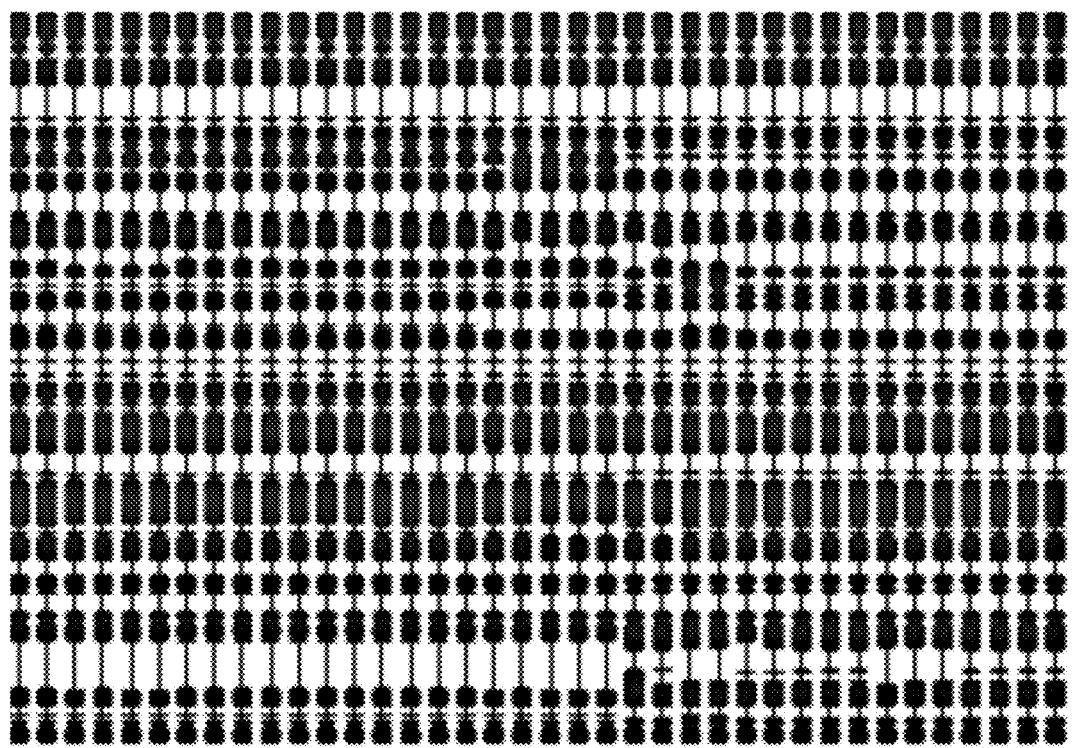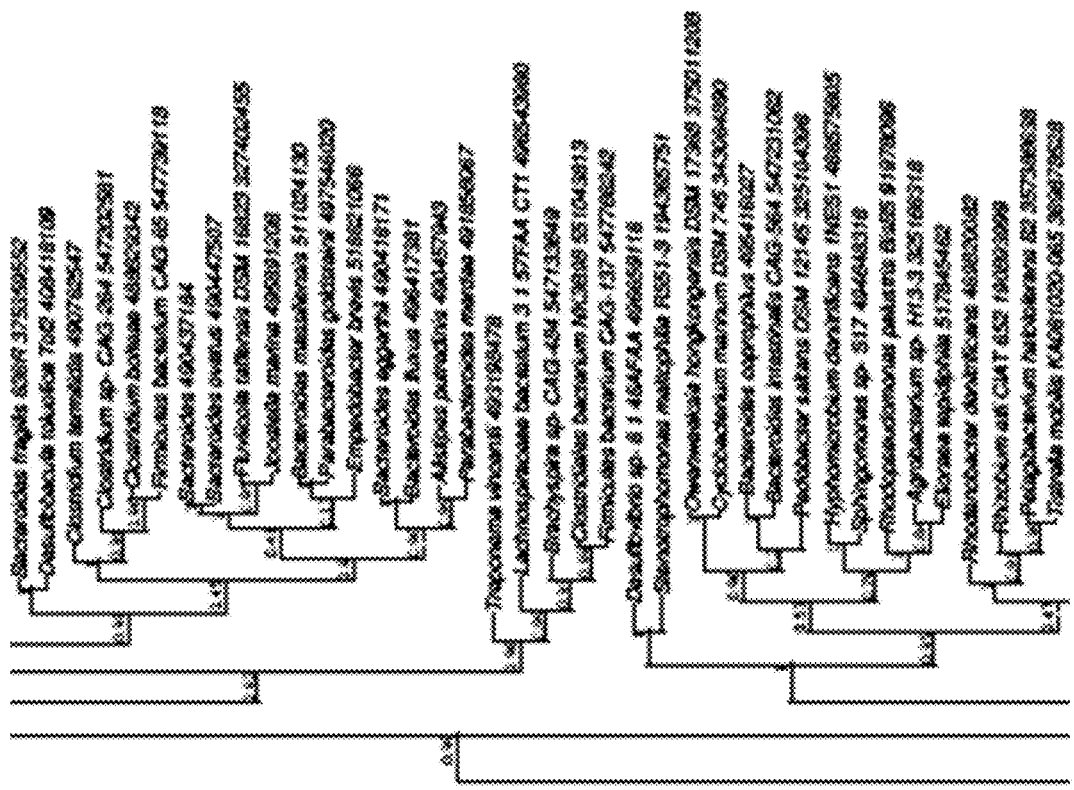
FIG. 8A (cont'd)

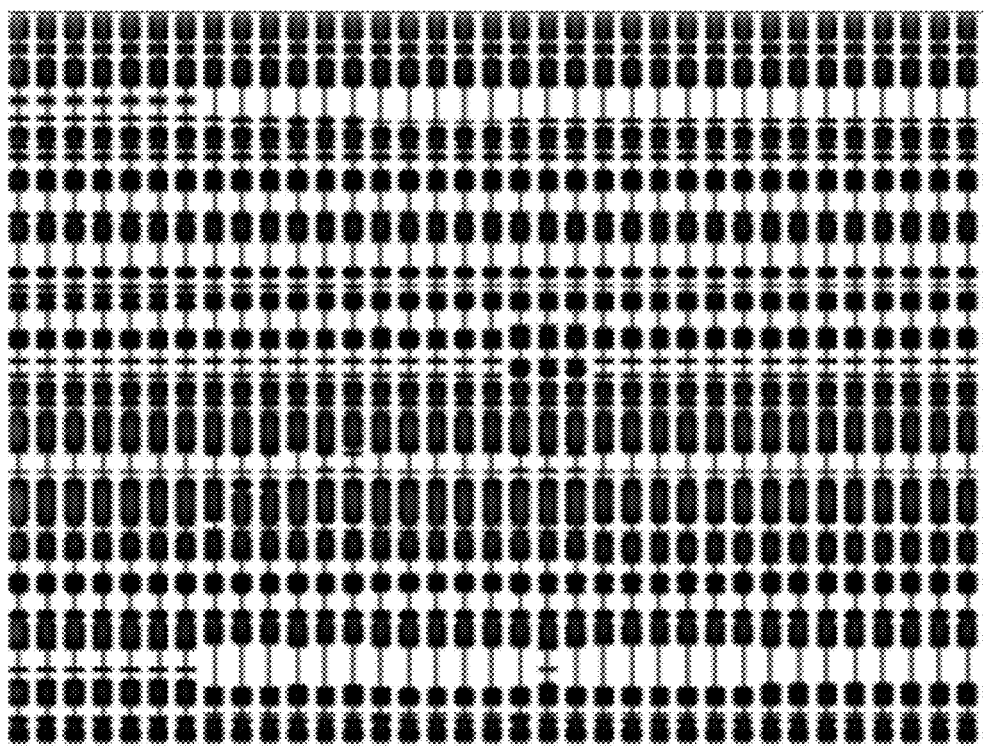
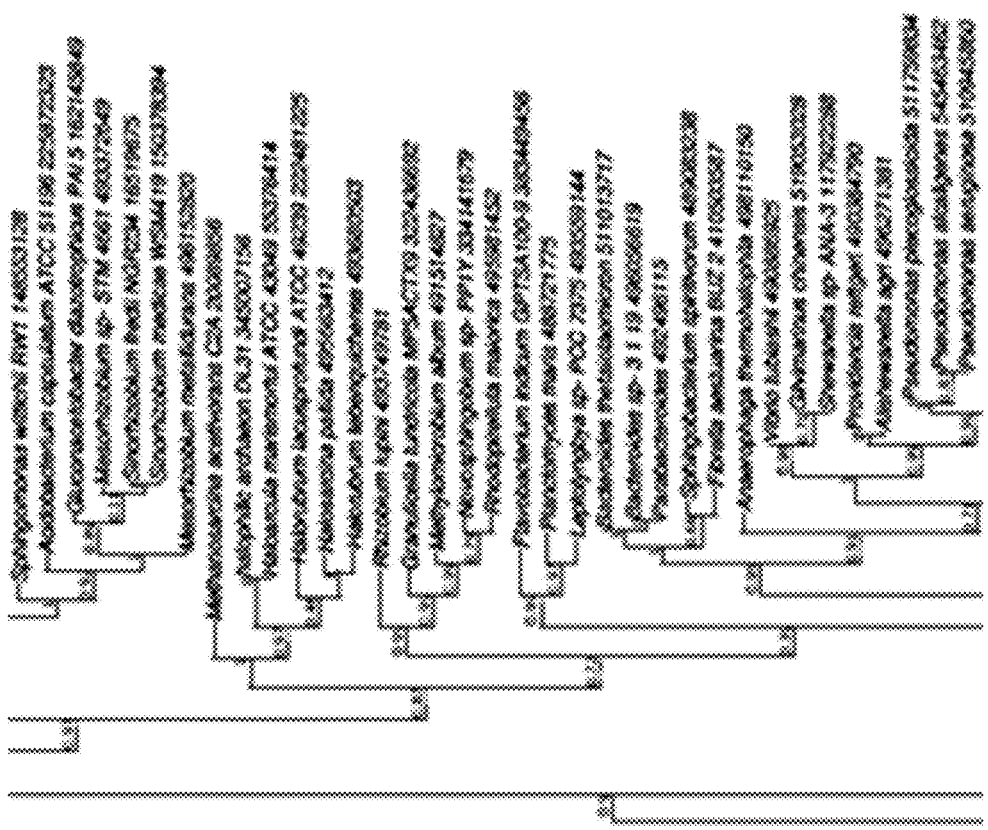
FIG. 8B

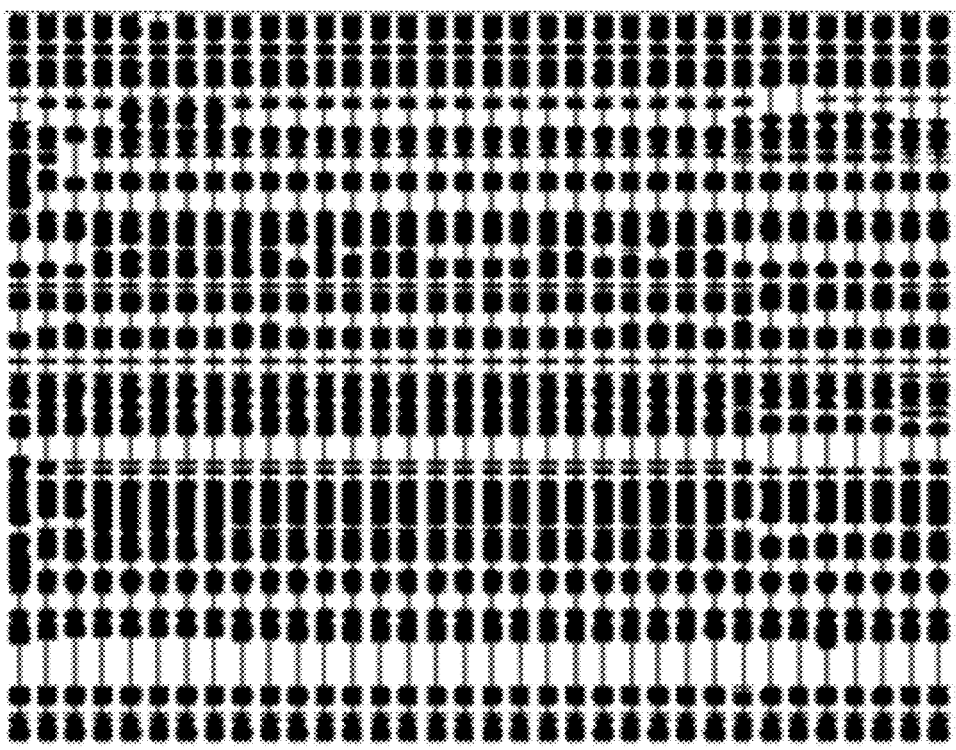
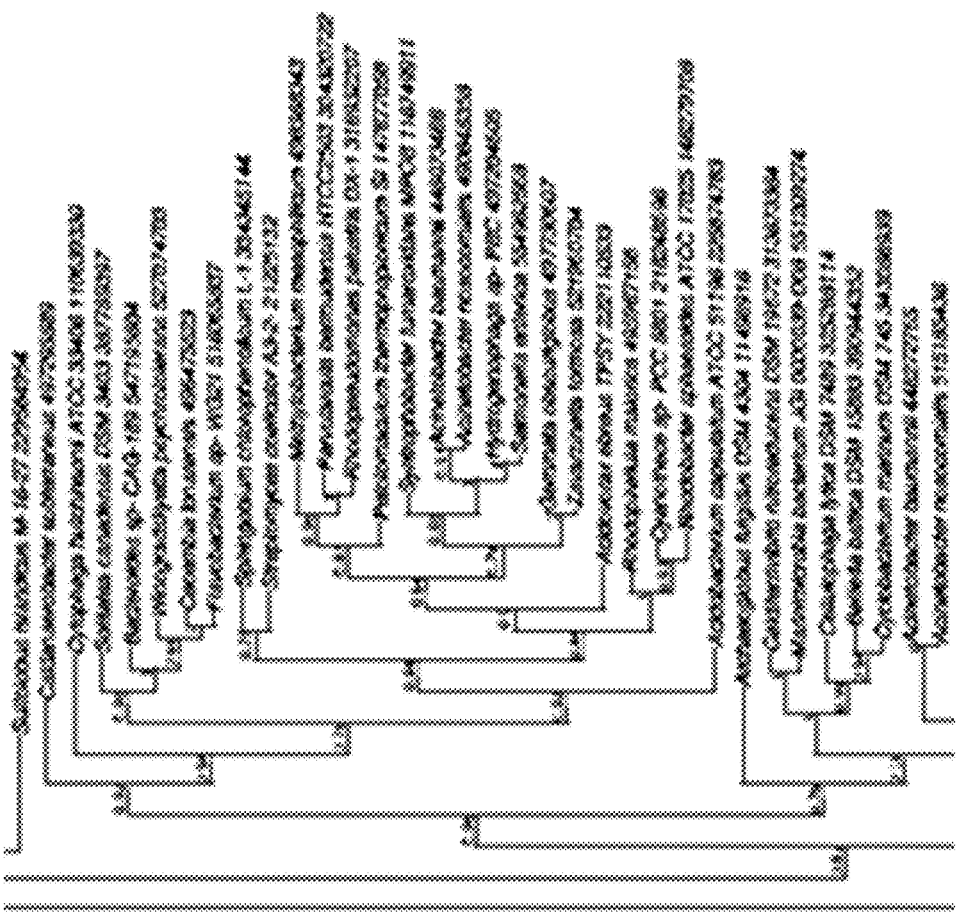
FIG. 8C

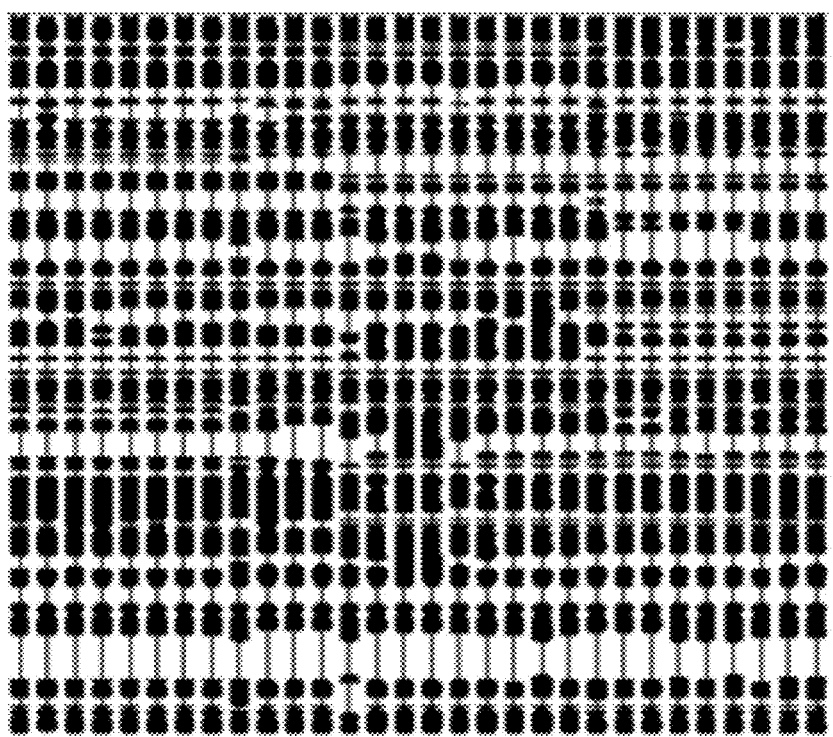
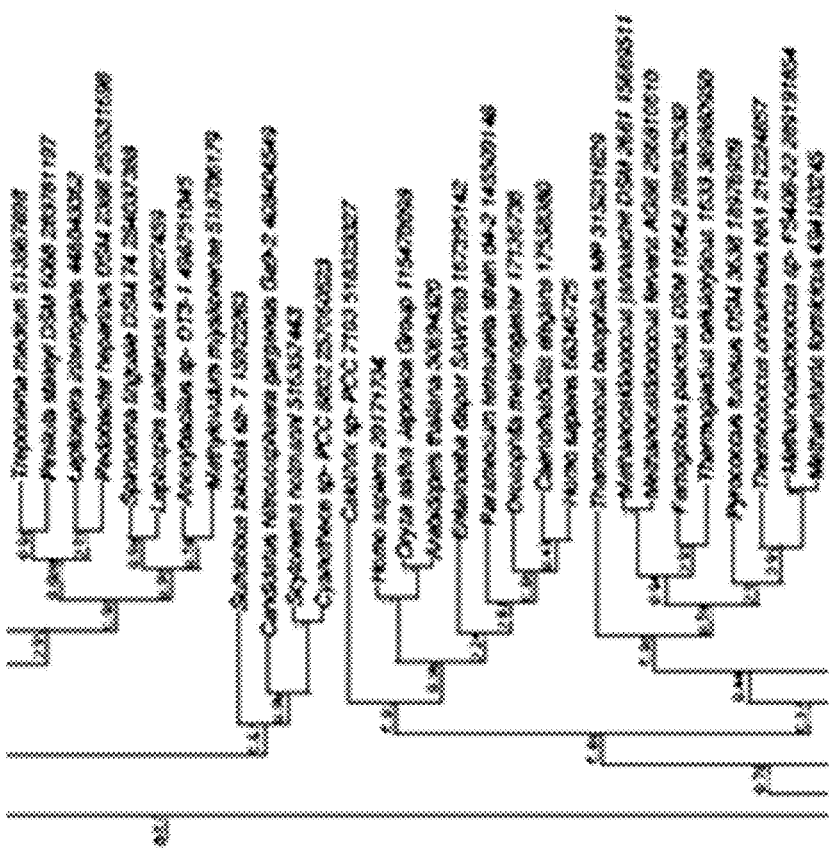
FIG. 8C (cont'd)

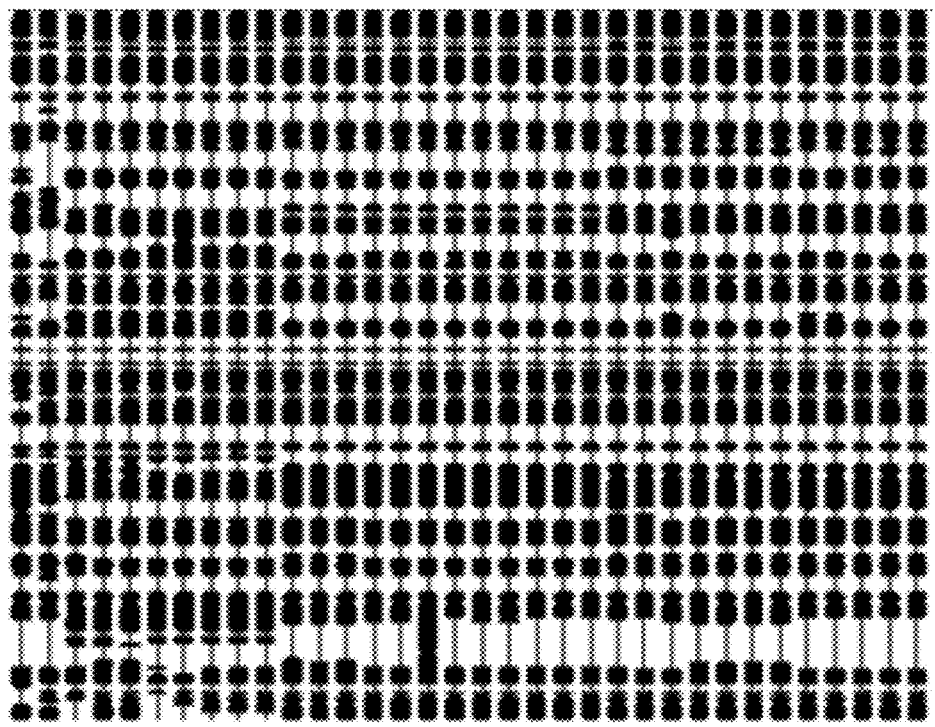
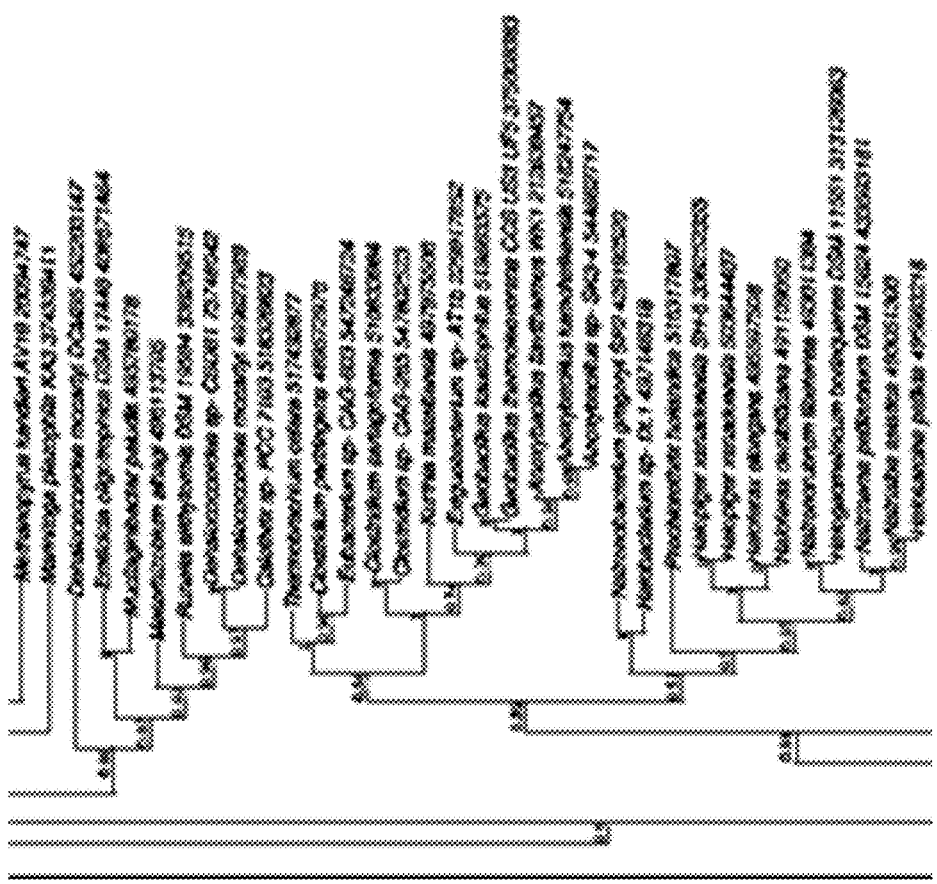
FIG. 8D

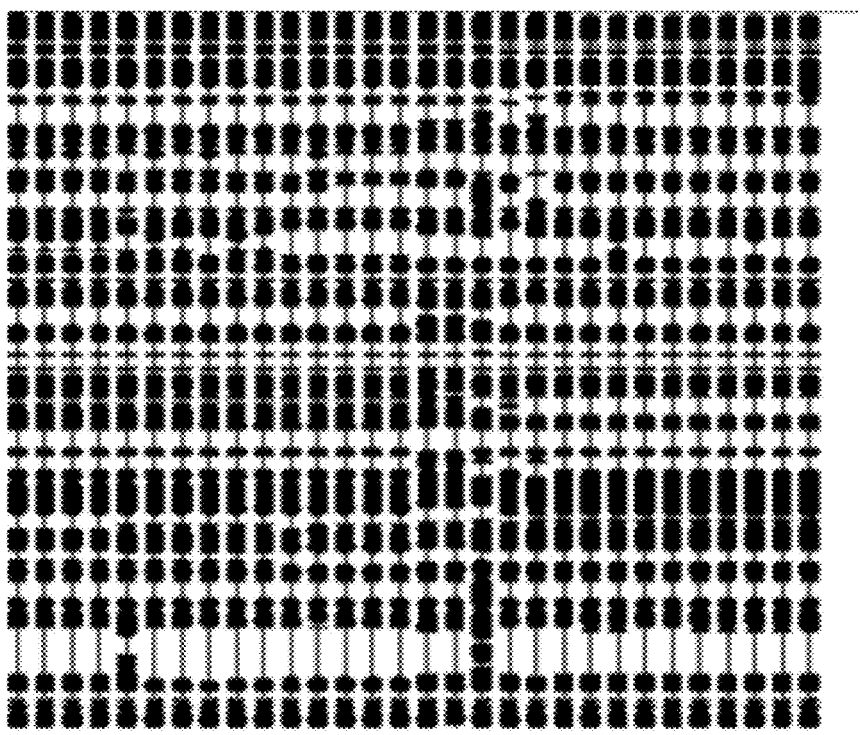
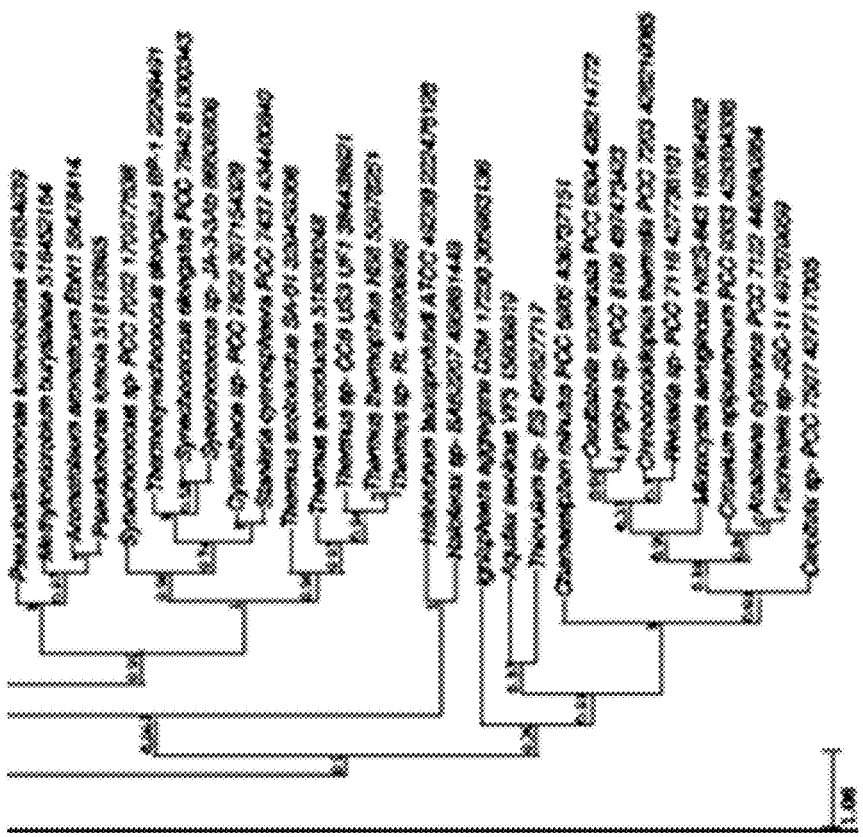
FIG. 8D (cont'd)

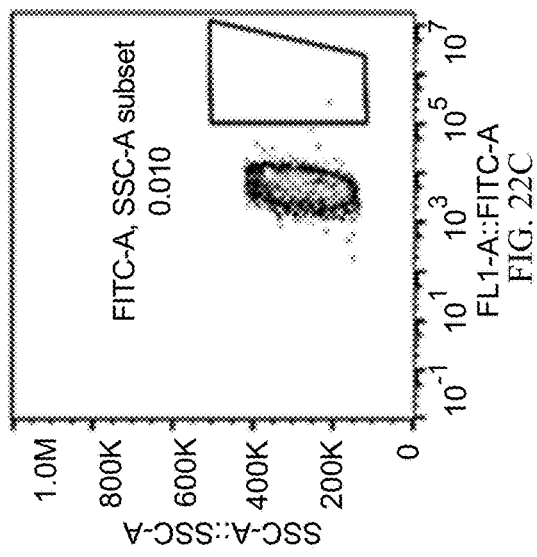
FIG. 22A
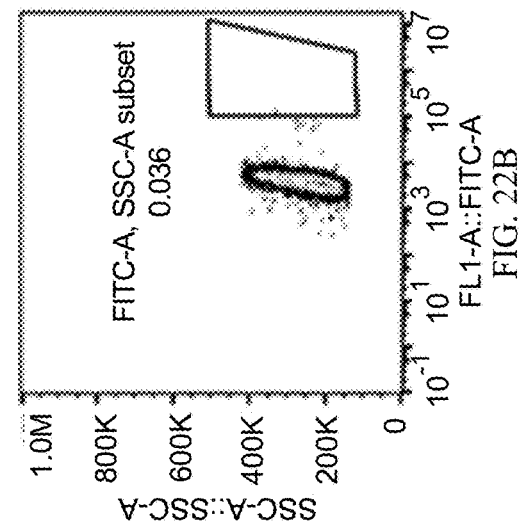
FIG. 22B
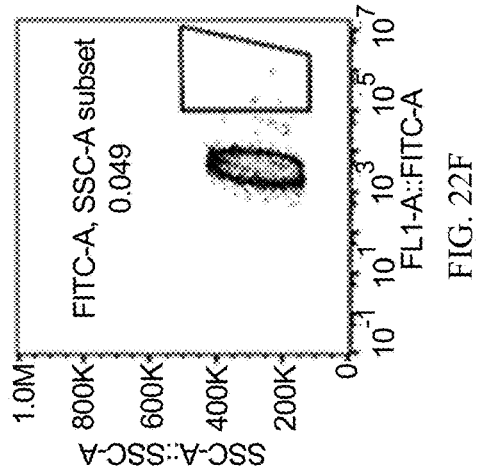
FIG. 22C
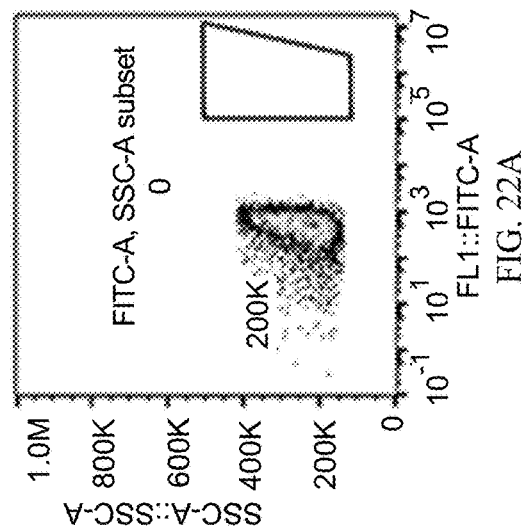
FIG. 22D
FIG. 22E
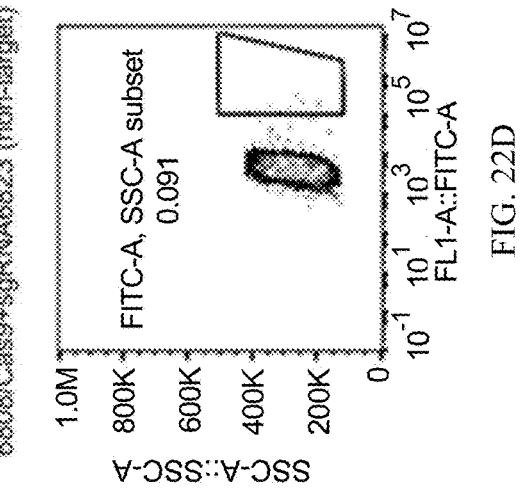
FIG. 22F

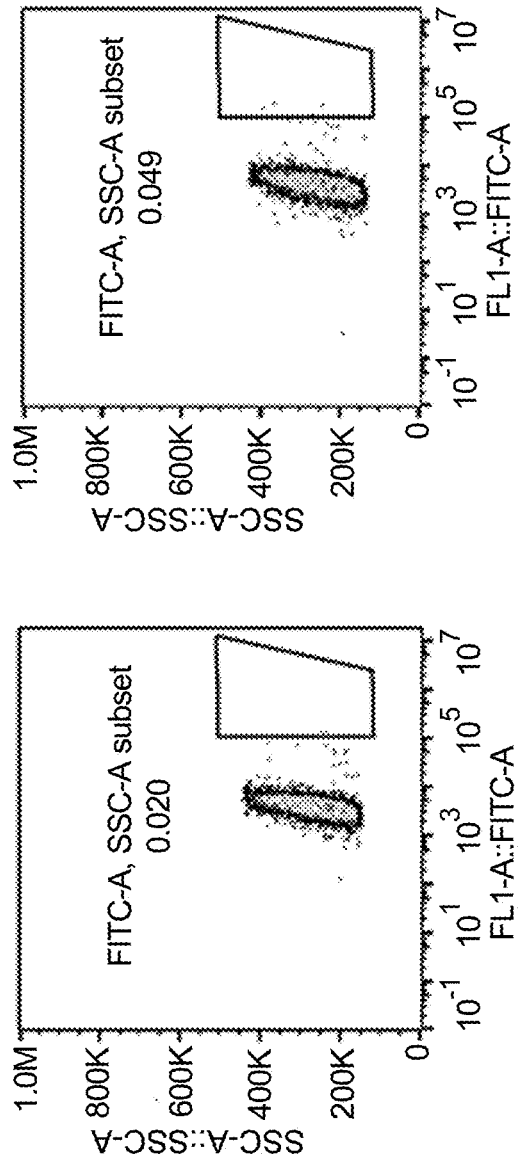

| | aGEM | CRISPR/TALEN/ZFN/MegaN |
|---|---|---|
| Energy | Exothermic | Endothermic |
| Entropy | Entropy Decreased (Efficient, High Fidelity DNA Repair) | Entropy Increased (Defective DNA repair) |
| Human Clinical Translation | Physiologic Natural Healthy Common State | Pathologic Rare Diseased State |

$$\underset{\text{Efficiency of DNA repair}}{\Delta G} = \underset{\text{Energy}}{\Delta H} - \underset{\text{Entropy}}{T \Delta S}$$

FIG. 33

NUCLEASE SYSTEMS FOR GENETIC ENGINEERING

CROSS-REFERENCE

This application is a continuation of International Application No. PCT/US2018/050029, filed Sep. 7, 2018, which claims priority to U.S. Provisional Application No. 62/555,564 filed Sep. 7, 2017, and U.S. Provisional Application No. 62/652,047 filed Apr. 3, 2018, which applications are incorporated herein by reference in their entireties.

SEQUENCE LISTING

The instant application contains a Sequence Listing which has been submitted electronically in ASCII format and is hereby incorporated by reference in its entirety. Said ASCII copy, created on Sep. 7, 2018, is named 079445-001620US-1182584_SL.txt and is 1,150,548 bytes in size.

BACKGROUND

With the rapid progress being made in genome sciences, effective genome engineering holds great promise both in understanding the molecular bases of human diseases and in treating human disorders with identifiable alterations in the genome. The past few years have witnessed a rapid rise of the RNA-guided CRISPR/Cas9 technology from obscurity. Significant efforts are being devoted to optimizing the current CRISPR/Cas9 system and/or to identifying more Cas9-like nucleases with better efficiency and specificity.

Similarly, significant efforts are being employed to identify new systems that can be harnessed for genome editing with improved specificity and efficiency.

INCORPORATION BY REFERENCE

All publications, patents, and patent applications herein are incorporated by reference to the same extent as if each individual publication, patent, or patent application was specifically and individually indicated to be incorporated by reference. In the event of a conflict between a term herein and a term in an incorporated reference, the term herein controls.

SUMMARY OF THE INVENTION

Disclosed herein is a polypeptide construct comprising: a prokaryotic RNase H-like domain-containing (RHDC) polypeptide sequence and a nucleic acid unwinding polypeptide sequence. In some cases, the RHDC polypeptide sequence cleaves a nucleic acid in a target polynucleotide sequence at a mesophilic temperature. In some cases the target polynucleotide sequence is bound by a guide DNA. In some cases, the RHDC polypeptide sequence is fused to the nucleic acid unwinding polypeptide sequence. In some cases, at least one of the RHDC polypeptide sequence or said nucleic acid unwinding polypeptide sequence are derived from a mesophilic organism. In some cases, the RHDC polypeptide sequence cleaves a nucleic acid in the target polynucleotide sequence at about 30° C., 31° C., 32° C., 33° C., 34° C., 35° C., 36° C., 37° C., 38° C. or 39° C. In some cases, the RHDC polypeptide sequence cleaves a nucleic acid in said target polynucleotide sequence at about 19° C., 20° C., 21° C., 22° C., 23° C., 24° C., 25° C., 26° C., 27° C., 28° C., 29° C. or 30° C. In some cases, the RHDC polypeptide sequence cleaves a nucleic acid in said target polynucleotide sequence at 37° C. In some cases, the mesophilic organism is a prokaryotic organism. In some cases, the prokaryotic organism is from a family selected from the group consisting of: bacteroidetes, proteobacteria, acidobacteria, actinobacteria, firmicutes, cyanobacteria, spirochaetes, deinococcus, verrucomicrobia, planctomycetes, balneolaeota, and chloroflexi. In some cases, the RHDC polypeptide sequence is derived from a polypeptide encoded by a gene located in an adjacent operon to at least one of a P-element induced WImpy testis (PIWI) gene, RuvC, Cas, Sir2, Mrr, TIR, PLD, REase, restriction endonuclease, DExD/H, superfamily II helicase, RRXRR (SEQ ID NO: 380), DUF460, DUF3010, DUF429, DUF1092, COG5558, OrfB_IS605, Peptidase_A17, Ribonuclease H-like domain, 3'-5' exonuclease domain, 3'-5' exoribonuclease Rv2179c-like domain, Bacteriophage Mu, transposase, DNA-directed DNA polymerase, family B, exonuclease domain, Exonuclease, RNase T/DNA polymerase III, yqgF gene, HEPN, RNase LS domain, LsoA catalytic domain, KEN domain, RNaseL, Irel, RNase domain, RloC, or PrrC. In some cases, the RHDC polypeptide sequence is derived from a polypeptide encoded by a gene located in an adjacent operon to at least one of a gene involved in defense, stress response, a Clustered Regularly Interspaced Short Palindromic Repeats (CRISPR), Argonaute, or DNA repair. In some cases, the RHDC polypeptide sequence is an Argonaute domain sequence. In some cases, the RHDC polypeptide sequence comprises a nuclease, nickase, RNase, recombinase, flippase, transposase, or a combination thereof. In some cases, the polypeptide construct further comprises an additional functional polypeptide sequence fused to the RHDC polypeptide sequence and the nucleic acid unwinding polypeptide sequence. In some cases, the nucleic acid unwinding polypeptide is of prokaryotic or archaeal origin. In some cases, the nucleic acid unwinding polypeptide comprises a helicase, a topoisomerase, a Cas, or a combination thereof. In some cases, the Cas is a catalytically dead Cas or partially dead Cas (nickase). In some cases, the catalytically dead Cas is selected from the group consisting of catalytically dead derivatives of: Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, xCas9, CasX, CasY, and CasRX. In some cases, the polypeptide construct further comprises an ATPase sequence. In some cases, the RHDC polypeptide sequence and the nucleic acid unwinding polypeptide sequence are fused by a linker sequence. In some cases, the linker is a polypeptide linker that comprises: a GSGSGS sequence or multiple copies of GSGSGS (SEQ ID NO: 381), non-charged amino acids, alpha-helical domains, or peptides with ligand-inducible conformational changes. In some cases, the linker is a polypeptide linker. In some cases, the nucleic acid unwinding polypeptide sequence and the RHDC polypeptide sequence are expressed in the same frame. In some cases, the polypeptide construct binds to the guide DNA. In some cases, the guide DNA is from about 1 base pair to about 30 base pairs in length. In some cases, the guide DNA is complementary to the target polynucleotide sequence. In some cases, the target polynucleotide sequence comprises a gene sequence. In some cases, the polypeptide construct produces a disruption in the gene sequence when introduced into a cell. In some cases, the disruption comprises a double strand break or a single strand break. In some cases, the RHDC polypeptide sequence comprises a firmicutes Argonaute domain, or a functional fragment or variant thereof, that cleaves a nucleic acid at 37° C. In some cases, the RHDC polypeptide sequence comprises a *Clostridium* Argonaute domain, or a functional fragment or variant thereof, that cleaves a nucleic acid at 37° C. In some cases, the *Clostridium* Argonaute domain comprises a *Clostridium disporicum* Argonaute domain, or a functional fragment or variant thereof. In some cases, the RHDC polypeptide sequence comprises a *Thermoactinomyces* Argonaute domain, or a functional fragment or variant thereof, that cleaves a nucleic acid at 37° C. In some cases, the *Thermoactinomyces* Argonaute domain comprises a *Thermoactinomyces* sp CDF Argonaute domain, or a functional fragment or variant thereof. In some cases, the RHDC polypeptide sequence comprises a *Methylobacter* Argonaute domain, or a functional fragment or variant thereof, that cleaves a nucleic acid at 37° C. In some cases, the *Methylobacter* Argonaute domain comprises a *Methylobacter whittenburyi* Argonaute domain, or a functional fragment or variant thereof. In some cases, the RHDC polypeptide sequence comprises a *Thermosynechococcus* Argonaute domain, or a functional fragment or variant thereof, that cleaves a nucleic acid at 37° C. In some cases, the *Thermosynechococcus* Argonaute domain comprises a *Thermosynechococcus elongates* Argonaute domain, or a functional fragment or variant thereof.

Disclosed herein is a polypeptide construct comprising a synthetic fusion of an Argonaute polypeptide sequence and a nucleic acid unwinding polypeptide sequence. In some cases, the Argonaute polypeptide sequence cleaves a target nucleic acid at a mesophilic temperature. In some cases, at least one of the Argonaute polypeptide sequence or the nucleic acid unwinding polypeptide sequence are derived from a mesophilic organism. In some cases, the Argonaute polypeptide sequence cleaves the target nucleic acid at about 19° C. to 40° C. In some cases, the Argonaute polypeptide sequence cleaves the target nucleic acid at about 30° C., 31° C., 32° C., 33° C., 34° C., 35° C., 36° C., 37° C., 38° C. or 39° C. In some cases, the Argonaute polypeptide sequence cleaves the target nucleic acid at 37° C. In some cases, the Argonaute polypeptide sequence is an archaeal Argonaute polypeptide sequence. In some cases, the Argonaute polypeptide sequence comprises a nuclease, nickase, RNase, recombinase, flippase, transposase, or a combination thereof. In some cases, the Argonaute polypeptide sequence and the nucleic acid unwinding polypeptide sequence are fused by a linker sequence.

Provided herein is an ex vivo cell comprising a polypeptide construct.

Provided herein is a nucleic acid encoding a polypeptide construct.

Provided herein is a composition comprising a polypeptide construct.

Provided herein is a method of genomic editing comprising contacting a cell with a polypeptide construct.

Provided herein is a kit comprising: a polypeptide construct and instructions for use thereof. In some cases, a kit can further comprise a container.

Provided herein is a polypeptide construct comprising: an RNase H-like domain-containing (RHDC) polypeptide sequence, a nucleic acid unwinding polypeptide sequence, and a nucleic-acid insertion polypeptide sequence. In some cases, the RHDC polypeptide sequence cleaves a nucleic acid in a target polynucleotide sequence at a mesophilic temperature to generate a cleaved nucleic acid. In some cases, the target polynucleotide sequence is bound by a guide DNA. In some cases, the RHDC polypeptide sequence is fused to the nucleic acid unwinding polypeptide sequence. In some cases, the nucleic-acid insertion polypeptide sequence inserts a nucleic acid sequence in the cleaved nucleic acid.

Provided herein is a polypeptide construct comprising: an RNase H-like domain-containing (RHDC) polypeptide sequence and a regulatory domain polypeptide (RDP) sequence. In some cases, the polypeptide construct further comprises a nucleic acid unwinding domain sequence. In some cases, the nucleic acid unwinding domain sequence comprises a catalytically dead Cas, a helicase, or a topoisomerase. In some cases, the RDP sequence is a Rad51 polypeptide, a recombinase, an epigenetic modulator, or a domain involved in germ cell repair. In some cases, the RHDC polypeptide sequence comprises a Firmicutes Argonaute domain, or a functional fragment or variant thereof, that cleaves a nucleic acid in said target polynucleotide sequence at 37° C. In some cases, the RHDC polypeptide sequence comprises a *Clostridium* Argonaute domain, or a functional fragment or variant thereof, that cleaves a nucleic acid in said target polynucleotide sequence at 37° C. In some cases, the *Clostridium* Argonaute domain comprises a *Clostridium disporicum* Argonaute domain, or a functional fragment or variant thereof. In some cases, the RHDC polypeptide sequence comprises a *Thermoactinomyces* Argonaute domain, or a functional fragment or variant thereof, that cleaves a nucleic acid in said target polynucleotide sequence at 37° C. In some cases, the *Thermoactinomyces* Argonaute domain comprises a *Thermoactinomyces* sp CDF Argonaute domain, or a functional fragment or variant thereof. In some cases, the RHDC polypeptide comprises a *Methylobacter* Argonaute domain, or a functional fragment or variant thereof, that cleaves a nucleic acid in said target polynucleotide sequence at 37° C. In some cases, the *Methylobacter* Argonaute domain comprises a *Methylobacter* whittenburyi Argonaute domain, or a functional fragment or variant thereof. In some cases, the RHDC polypeptide comprises a *Thermosynechococcus* Argonaute domain, or a functional fragment or variant thereof, that cleaves a nucleic acid in said target polynucleotide sequence at 37° C. In some cases, the *Thermosynechococcus* Argonaute domain comprises a *Thermosynechococcus elongates* Argonaute domain, or a functional fragment or variant thereof.

Disclosed herein is a polypeptide construct comprising: an Argonaute polypeptide sequence, a nucleic acid unwinding polypeptide sequence, and a nucleic-acid insertion polypeptide sequence. In some cases, the Argonaute polypeptide sequence cleaves a nucleic acid at a mesophilic temperature and the nucleic acid-insertion polypeptide sequence inserts a nucleic acid sequence in the cleaved nucleic acid. In some cases, at least one of the Argonaute polypeptide sequence or the nucleic acid unwinding polypeptide sequence are derived from a mesophilic organism. In some cases, the Argonaute polypeptide sequence cleaves a nucleic acid from 19° C. to 40° C. In some cases, the Argonaute polypeptide sequence cleaves a nucleic acid at about 30° C., 31° C., 32° C., 33° C., 34° C., 35° C., 36° C., 37° C., 38° C. or 39° C. In some cases, the Argonaute polypeptide sequence cleaves a nucleic acid at 37° C. In some cases, the Argonaute polypeptide sequence is an archaeal Argonaute polypeptide sequence. In some cases, the Argonaute polypeptide sequence comprises a nuclease, nickase, RNase, recombinase, flippase, transposase, or a combination thereof. In some cases, the Argonaute polypeptide sequence and the nucleic acid unwinding polypeptide sequence are joined by a linker.

Provided herein is an ex vivo cell comprising a polypeptide construct.

Provided herein is a nucleic acid encoding a polypeptide construct.

Provided herein is a composition comprising a polypeptide construct.

Provided herein is a method of genomic editing comprising contacting a cell with a polypeptide construct.

Provided herein is a method comprising: contacting a cell with a nucleic acid editing system that comprises: (i) an RNase H-like domain-containing (RHDC) polypeptide sequence; (ii) a nucleic acid unwinding agent sequence; (iii) a guide nucleic acid; and (iv) a regulatory domain polypeptide (RDP) sequence. In some cases, the contacting results in editing of a nucleic acid in the cell. In some cases, the RHDC sequence, the nucleic acid unwinding agent sequence, and the RDP sequence are in a protein complex. In some cases, the protein complex associates with the guide nucleic acid to form a guided editing complex. In some cases, the guide nucleic acid is a guide DNA. In some cases, the guide nucleic acid is a guide RNA. In some cases, the RHDC domain is from an Argonaute. In some cases, the nucleic acid unwinding agent sequence comprises a helicase, a topoisomerase, a Cas, or a combination thereof. In some cases, the Cas is a catalytically dead or partially catalytically dead Cas. In some cases, the RDP sequence comprises a recombinase, an epigenetic modulator, a germ cell repair domain, a DNA repair protein, or a combination thereof. In some cases, the RDP sequence controls, in whole or in part, the nucleic acid editing. In some cases, the guide nucleic acid is complementary to the nucleic acid in the cell. In some cases, the nucleic acid in the cell encodes for a disease-related antigen. In some cases, the disease is a heart disease, diabetes, cancer, neurological disease, mental illness, a genetic disease, or a combination thereof. In some cases, the method has a lower energy requirement as compared to a corresponding nucleic acid editing method without the RDP sequence, and wherein the energy requirement is determined by calculating difference in ATP usage by providing a predetermined amount of ATP into a nucleic acid editing system, and calculating ATP usage based on ([ATP]-[ADP])/[modified DNA] after the editing. In some cases, the energy level is reduced by about 4%, 5%, 6%, 7%, 8%, 9%, 10%, 15%, 20%, or up to 25% when the nucleic acid editing system comprising the RDP sequence is utilized as compared to the comparable nucleic acid editing system without the RDP sequence. In some cases, the method favors a genomic editing repair towards homology directed repair over non-homologous end joining. In some cases, the method further comprises introducing a transgene into a genome of the cell. In some cases, the introducing is performed non-virally. In some cases, the introducing is performed virally. In some cases, the cell is a primary cell or a recombinant cell. In some cases, the cell is a human cell. In some cases, the nucleic acid editing system is electroporated into the cell. In some cases, the method further comprises introducing a cell edited by the method to a subject in need thereof. In some cases, the RHDC polypeptide sequence comprises a firmicutes Argonaute domain, or a functional fragment or variant thereof, that cleaves a nucleic acid at 37° C. In some cases, the RHDC polypeptide sequence comprises a *Clostridium* Argonaute domain, or a functional fragment or variant thereof, that cleaves the nucleic acid at 37° C. In some cases, the *Clostridium* Argonaute domain comprises a *Clostridium disporicum* Argonaute domain, or a functional fragment or variant thereof. In some cases, the RHDC polypeptide sequence comprises a *Thermoactinomyces* Argonaute domain, or a functional fragment or variant thereof, that cleaves the nucleic acid at 37° C. In some cases, the *Thermoactinomyces* Argonaute domain comprises a *Thermoactinomyces* sp CDF Argonaute domain, or a functional fragment or variant thereof. In some cases, the RHDC polypeptide sequence comprises a *Methylobacter* Argonaute domain, or a functional fragment or variant thereof, that cleaves the nucleic acid at 37° C. In some cases, the *Methylobacter* Argonaute domain comprises a *Methylobacter whittenburyi* Argonaute domain, or a functional fragment or variant thereof. In some cases, the RHDC polypeptide sequence comprises a *Thermosynechococcus* Argonaute domain, or a functional fragment or variant thereof, that cleaves the nucleic acid at 37° C. In some cases, the *Thermosynechococcus* Argonaute domain comprises a *Thermosynechococcus elongates* Argonaute domain, or a functional fragment or variant thereof.

Provided herein is an isolated nucleic acid sequence comprising at least 60% identity to any one of SEQ ID NOs: 161 to 252. In some cases, the isolated nucleic acid sequence comprises at least 65%, 70%, 75%, 80%, 85%, 90%, 95%, 96%, 97%, 98%, 99%, or 100% identity to any one of SEQ ID NOs: 161 to 252.

Provided herein is a cell comprising an isolated nucleic acid sequence.

Provided herein is a cell comprising a protein encoded by an isolated nucleic acid sequence. In some cases, the cell further comprises a guide nucleic acid. In some cases, the cell further comprises a regulatory domain polypeptide (RDP).

Provided herein is an isolated polypeptide sequence comprising at least 60% identity to any one of SEQ ID NOs: 20 to 38. In some cases, the isolated polypeptide sequence further comprises at least 65%, 70%, 75%, 80%, 85%, 90%, 95%, 96%, 97%, 98%, 99%, or 100% identity to any one of SEQ ID NOs: 20 to 38.

Provided herein is a cell comprising an isolated polypeptide sequence. In some cases, the cell further comprises a guide nucleic acid. In some cases, the cell further comprises a regulatory domain polypeptide (RDP) sequence.

Provided herein is a method of genome editing comprising: contacting a population of cells with a polypeptide construct, wherein at least about 5% of the population comprises a genomic disruption after the contacting. In some cases, at least about 10%, 15%, 20%, 25%, 30%, 35%, 40%, 45%, 50%, 55%, or 60% of the population comprises the genomic disruption after the contacting.

Provided herein is a method of genome editing comprising: contacting a population of cells with an isolated polynucleic acid encoding a polypeptide construct, wherein at least about 5% of the population comprises a genomic disruption after the contacting. In some cases, at least about 10%, 15%, 20%, 25%, 30%, 35%, 40%, 45%, 50%, 55%, or 60% of the population comprises the genomic disruption after the contacting.

Provided herein is a method of genome editing comprising: (a) unwinding a genomic sequence with a Clustered Regularly Interspaced Short Palindromic Repeats (CRISPR) protein, thereby generating an unwound genomic sequence; and (b) introducing a genomic disruption in the unwound genomic sequence by contacting the unwound genomic sequence with a mesophilic RNase H-like domain-containing (RHDC) polypeptide, thereby editing the genome. In some cases, the CRISPR protein is a catalytically dead Cas or partially dead Cas (nickase). In some cases, the catalytically dead Cas is selected from the group consisting of catalytically dead derivatives of: Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, xCas9, CasX, CasY, and CasRX. In some cases, the Cas is dCas9. In some cases, the RHDC polypeptide comprises a polypeptide selected from RuvC, HNH, RNase H, PIWI, or a combination thereof. In some cases, the method further comprises a regulatory domain polypeptide (RDP). In some cases, the RDP comprises Rad51, a recombinase, an epigenetic modulator, or a domain involved in germ cell repair. In some cases, the genomic sequence is in a primary cell or a recombinant cell. In some cases, the genomic sequence is in a human cell.

Provided herein is a method of treating a disease in a subject in need thereof comprising administering a cell edited by a method disclosed herein. In some cases, the disease is heart disease, diabetes, cancer, neurological disease, immunological disease, mental illness, a genetic disease, or a combination thereof. In some cases, a measure of the disease is reduced by about 10% to about 50% after the administering.

Provided herein is a method of stabilizing a disease in a subject in need thereof comprising administering a cell edited by a method disclosed herein. In some cases, the stabilizing comprises a less than 5% change in a level of a disease in the subject after the administering.

Provided herein is a nucleic acid construct encoding a prokaryotic RNase H-like domain-containing (RHDC) polypeptide sequence and a nucleic acid unwinding polypeptide sequence, wherein the RHDC polypeptide sequence cleaves a nucleic acid in a target polynucleotide sequence at a mesophilic temperature, wherein the target polynucleotide sequence is bound by a guide DNA, and wherein the RHDC polypeptide sequence is fused to the nucleic acid unwinding polypeptide sequence in a polypeptide encoded by the nucleic acid construct.

Provided herein is a nucleic acid construct encoding an RNase H-like domain-containing (RHDC) polypeptide sequence, a nucleic acid unwinding polypeptide sequence, and a nucleic-acid insertion polypeptide sequence, wherein a protein encoded by said RHDC polypeptide sequence cleaves a nucleic acid in a target polynucleotide sequence at a mesophilic temperature, wherein the target polynucleotide sequence is bound by a guide DNA, wherein the RHDC polypeptide sequence is fused to the nucleic acid unwinding polypeptide sequence in a polypeptide encoded by the nucleic acid construct, and wherein the nucleic-acid insertion polypeptide sequence inserts a nucleic acid sequence in the cleaved nucleic acid.

Provided herein is a cell comprising: a polypeptide construct comprising a prokaryotic RNase H-like domain-containing (RHDC) polypeptide and a nucleic acid unwinding polypeptide, wherein the RHDC polypeptide sequence cleaves a nucleic acid at a mesophilic temperature, wherein the nucleic acid-cleaving activity is bound by a guide DNA, and wherein the RHDC polypeptide sequence is fused to the nucleic acid unwinding polypeptide.

Provided herein is a cell comprising: a polypeptide construct comprising an RNase H-like domain-containing (RHDC) polypeptide sequence, a nucleic acid unwinding polypeptide sequence, and a nucleic-acid insertion polypeptide sequence, wherein a polypeptide encoded by the RHDC polypeptide sequence cleaves a nucleic acid in a target polynucleotide sequence at a mesophilic temperature, wherein the target polynucleotide sequence is bound by a guide DNA, wherein the RHDC polypeptide sequence is fused to the nucleic acid unwinding polypeptide, and wherein the nucleic-acid insertion polypeptide sequence inserts a nucleic acid sequence in the cleaved nucleic acid.

Provided herein is a cell comprising: a nucleic acid construct encoding a prokaryotic RNase H-like domain-containing (RHDC) polypeptide sequence and a nucleic acid unwinding polypeptide sequence, wherein the RHDC polypeptide sequence cleaves a nucleic acid in a target polynucleotide sequence at a mesophilic temperature, wherein the target polynucleotide sequence is bound by a guide DNA, and wherein the RHDC polypeptide sequence is fused to the nucleic acid unwinding polypeptide sequence.

Provided herein is a cell comprising: a nucleic acid construct encoding an RNase H-like domain-containing (RHDC) polypeptide sequence, a nucleic acid unwinding polypeptide sequence, and a nucleic-acid insertion polypeptide sequence, wherein the RHDC polypeptide sequence cleaves a nucleic acid in a target polynucleotide sequence at a mesophilic temperature, wherein the target polynucleotide sequence is bound by a guide DNA, wherein the RHDC polypeptide sequence is fused to the nucleic acid unwinding polypeptide sequence, and wherein the nucleic-acid insertion polypeptide sequence inserts a nucleic acid sequence in the cleaved nucleic acid.

Disclosed herein is a prokaryotic polypeptide construct comprising an RNase H-like domain-containing (RHDC) polypeptide sequence and a nucleic acid unwinding polypeptide. The RHDC polypeptide cleaves a nucleic acid at a mesophilic temperature. The nucleic acid-cleaving activity is directed by a guide DNA, and the RHDC polypeptide is fused to the nucleic acid unwinding polypeptide.

Disclosed herein is a polypeptide construct comprising an RNase H-like domain-containing (RHDC) polypeptide and a nucleic acid unwinding polypeptide. The RHDC polypeptide cleaves a nucleic acid at a mesophilic temperature. The nucleic acid-cleaving activity is directed by a guide DNA, and the RHDC polypeptide is fused to the nucleic acid unwinding polypeptide.

Disclosed herein is a polypeptide construct comprising an Argonaute polypeptide and a nucleic acid unwinding polypeptide. The Argonaute polypeptide cleaves a nucleic acid at a mesophilic temperature. In some cases, at least one of the RHDC polypeptide or the nucleic acid unwinding polypeptide are derived from a mesophilic organism. In some cases, at least one of the Argonaute polypeptide or the nucleic acid unwinding polypeptide are derived from a mesophilic organism. The RHDC polypeptide can cleave a nucleic acid from about 30° C., 31° C., 32° C., 33° C., 34° C., 35° C., 36° C., 37° C., 38° C. to about 39° C. In some cases, the RHDC polypeptide cleaves a nucleic acid from about 19° C. to about 40° C. In some cases, the RHDC polypeptide cleaves a nucleic acid at 37° C. In some cases, the Argonaute polypeptide cleaves a nucleic acid at about 30° C., 31° C., 32° C., 33° C., 34° C., 35° C., 36° C., 37° C., 38° C. or 39° C. In some cases, the Argonaute polypeptide cleaves a nucleic acid at 37° C. In some cases, the mesophilic organism is a prokaryotic organism. The prokaryotic organism can be from a family selected from the group consisting of: bacteroidetes, proteobacteria, acidobacteria, actinobacteria, firmicutes, cyanobacteria, spirochaetes, deinococcus, verrucomicrobia, planctomycetes, balneolaeota, and chloroflexi. The RHDC polypeptide can be an archaeal Argonaute polypeptide. The Argonaute polypeptide can be an archaeal Argonaute polypeptide. The RHDC polypeptide can be encoded by a gene located in an adjacent operon to at least one of a P-element induced WImpy testis (PIWI) gene, RuvC, Cas, Sir2, Mrr, TIR, PLD, REase, restriction endonuclease, DExD/H, superfamily II helicase, RRXRR SEQ ID NO: 380), DUF460, DUF3010, DUF429, DUF1092, COG5558, OrfB_IS605, Peptidase_A17, Ribonuclease H-like domain, 3'-5' exonuclease domain, 3'-5' exoribonuclease Rv2179c-like domain, Bacteriophage Mu, transposase, DNA-directed DNA polymerase, family B, exonuclease domain, Exonuclease, RNase T/DNA polymerase III, yqgF gene, HEPN, RNase LS domain, LsoA catalytic domain, KEN domain, RNaseL, Irel, RNase domain, RloC, or PrrC. In some cases, the RHDC polypeptide is encoded by a gene located in an adjacent operon to at least one of a gene involved in defense, stress response, a Clustered Regularly Interspaced Short Palindromic Repeats (CRISPR), Argonaute, or DNA repair. In some cases, the RHDC polypeptide is an Argonaute domain. In some cases, the RHDC polypeptide encodes for a nuclease, nickase, RNase, recombinase, flippase, transposase, or a combination thereof. In some cases, the Argonaute polypeptide encodes for a nuclease, nickase, RNase, recombinase, flippase, transposase, or a combination thereof. In some cases, the RHDC polypeptide encodes for an RNase. The nucleic acid unwinding polypeptide can be of prokaryotic or archaeal origin. In some cases, the nucleic acid unwinding polypeptide encodes for a helicase, a topoisomerase, a Cas, or a combination thereof. A Cas can be a catalytically dead Cas or partially dead Cas (nickase). A Cas can be partially catalytically dead. A Cas can be partially dead. In some cases, a catalytically dead Cas is selected from the group consisting of: Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, xCas9, CasX, CasY, and CasRX. In some cases, a polypeptide construct further comprises an ATPase-encoding sequence. In some cases, the RHDC polypeptide and the nucleic acid unwinding polypeptide are joined by a linker. A linker can be a polypeptide linker that comprises: GSGSGS, non-charged amino acids, alpha-helical domains, and peptides with ligand-inducible conformational changes. In some cases, an Argonaute polypeptide and a nucleic acid unwinding polypeptide are joined by a linker. A linker can be a polypeptide linker. In some cases, a nucleic acid unwinding polypeptide and an RHDC polypeptide are expressed in the same frame. In some cases, a nucleic acid unwinding polypeptide and an Argonaute polypeptide are expressed in the same frame. In some cases, a protein encoded by a polypeptide construct is bound to a guide DNA. In some cases, a polypeptide construct can be bound to a guide nucleic acid. In some cases, a guide polynucleic acid can be a guide DNA (gDNA) or a guide RNA (gRNA). A guide DNA can be from about 1 base pair to about 30 base pairs in length. A guide DNA can be complementary to a target polynucleotide sequence. In some cases, a target polynucleotide sequence comprises a gene sequence. In some cases, a protein encoded by a polypeptide construct produces a disruption in a gene sequence when introduced into a cell. A disruption can comprise a double strand break or a single strand break.

Disclosed herein is an ex vivo cell comprising a polypeptide construct.

Disclosed herein is a method of genomic editing comprising contacting a cell with a protein encoded by a polypeptide construct.

Disclosed herein is a kit comprising a polypeptide construct and instructions for use thereof. A kit can further comprise a container.

Disclosed herein is a polypeptide construct comprising an RNase H-like domain-containing (RHDC) polypeptide and a nucleic acid unwinding polypeptide. A protein encoded by the RHDC polypeptide cleaves a nucleic acid at a mesophilic temperature. A nucleic acid-cleaving activity can be directed by a guide DNA. An RHDC polypeptide can be fused to a nucleic acid unwinding polypeptide, and a protein encoded by a polypeptide construct can further demonstrate nucleic acid-insertion activity.

Disclosed herein is a polypeptide construct comprising an Argonaute polypeptide and a nucleic acid unwinding polypeptide, a protein encoded by the Argonaute polypeptide cleaves a nucleic acid at a mesophilic temperature, and a protein encoded by the polypeptide construct further demonstrates nucleic acid-insertion activity.

Disclosed herein is a polypeptide construct comprising an RNase H-like domain-containing (RHDC) polypeptide and a regulatory domain polypeptide (RDP). A polypeptide construct can further comprise a nucleic acid unwinding domain. A nucleic acid unwinding domain can be a catalytically dead Cas, a helicase, or a topoisomerase. In some cases, an RDP is a Rad51 polypeptide, a recombinase, an epigenetic modulator, or a domain involved in germ cell repair.

Disclosed herein is a cell comprising a polypeptide construct.

Disclosed herein is a composition comprising a polypeptide construct.

Disclosed herein is a method comprising contacting a cell with a nucleic acid editing system that comprises an RNase H-like domain-containing (RHDC) polypeptide, a nucleic acid unwinding agent, a guide nucleic acid, and a regulatory domain polypeptide (RDP). In some cases, the RHDC, the nucleic acid unwinding agent, and the RDP are comprised in a protein complex. The protein complex associates with the guide nucleic acid to form a guided editing complex. In some cases, the guide nucleic acid is a guide DNA, a guide RNA, or a combination thereof. The RHDC domain can be from an Argonaute. The nucleic acid unwinding agent comprises a helicase, a topoisomerase, a Cas, or a combination thereof. In some cases, the Cas can be a catalytically dead Cas. A Cas can be partially catalytically dead. The RDP can comprise a recombinase, an epigenetic modulator, a germ cell repair domain, a DNA repair protein, or a combination thereof. In some cases, the RDP allows for tuning of nucleic acid editing. A guide nucleic acid can be complementary to a genomic sequence comprising a gene in a cell. In some cases, a gene encodes for a protein involved in a disease. A disease can be a heart disease, diabetes, cancer, neurological disease, immunological disease, mental illness, a genetic disease, or a combination thereof. In some cases, a method disclosed herein has a lower energy requirement as compared to a corresponding nucleic acid editing system without an RDP, and wherein the energy requirement is determined by calculating difference in ATP usage by providing a predetermined amount of ATP into nucleic acid editing systems, and calculating ATP usage based on ([ATP]-[ADP])/[modified DNA] after editing. In some cases, an energy level can be reduced by about 4%, 5%, 6%, 7%, 8%, 9%, 10%, 15%, 20%, or up to 25% when the nucleic acid editing system is utilized as compared to said comparable nucleic acid editing system without the RDP. In some cases, a method skews a genomic editing repair towards homology directed repair over non-homologous end joining. Disclosed herein can be a method further comprising introducing a transgene into a genome of a cell. In some cases, introducing a transgene is performed non-virally or virally. A cell can be a primary cell or a recombinant cell. A cell can be human or non-human A nucleic acid editing system can be electroporated into a cell. A method can further comprise introducing a cell edited by a nucleic acid editing system to a subject in need thereof.

Disclosed herein is an isolated nucleic acid sequence comprising at least 60% percent identity to any one of SEQ ID NOs: 161 to 252. An isolated nucleic acid sequence can further comprise at least about 65%, 70%, 75%, 80%, 85%, 90%, 95%, 96%, 97%, 98%, 99%, or up to about 100% identity to a sequence disclosed herein.

Disclosed herein is a cell comprising a protein encoded by an isolated nucleic acid sequences. A cell can further comprise a guide nucleic acid. A cell can further comprise a protein encoded by a regulatory domain polypeptide (RDP).

Disclosed herein is a method of genome editing comprising contacting a population of cells with a protein encoded by the polypeptide construct or the polypeptide construct, wherein at least about 5% of said population comprises a genomic disruption after the contacting. In some cases, at least about 10%, 15%, 20%, 25%, 30%, 35%, 40%, 45%, 50%, 55%, or 60% of said population of cells comprises a genomic disruption after the contacting.

Disclosed herein is a method of genome editing comprising unwinding a genomic sequence with Clustered Regularly Interspaced Short Palindromic Repeats (CRISPR) protein thereby generating an unwound genomic sequence; and introducing a genomic disruption in said unwound genomic sequence by contacting with an RNase H-like domain-containing (RHDC) polypeptide thereby editing the genome. A CRISPR protein can be a catalytically dead Cas or partially dead Cas (nickase). A Cas can be partially catalytically dead. The catalytically dead Cas can be selected from the group consisting of: Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, xCas9, CasX, CasY, and CasRX. The Cas can be dCas9. An RHDC polypeptide comprises a protein selected from RuvC, HNH, RNase H, PIWI, or a combination thereof. A method can further comprise a regulatory domain polypeptide (RDP). In some cases, an RDP can be Rad51, a recombinase, an epigenetic modulator, or a domain involved in germ cell repair. A cell can be a primary cell or a recombinant cell. A cell can be human or non-human.

Disclosed herein is a method of treating a disease in a subject in need thereof comprising administering a cell edited by the method. A disease can be heart disease, diabetes, cancer, neurological disease, immunological disease, mental illness, a genetic disease, or a combination thereof. In some cases, a level of a disease is reduced by about 10% to about 50% after said administering.

Disclosed herein is a method of stabilizing a disease in a subject in need thereof comprising administering a cell edited by the method. Stabilizing a disease can comprise less than a 5% change in a level of a disease in a subject.

In one embodiment, the present disclosure provides a polypeptide construct comprising an RNase-H-like domain-containing (RHDC) polypeptide and a nucleic acid unwinding polypeptide, wherein the RHDC polypeptide cleaves a nucleic acid at a mesophilic temperature, wherein the nucleic acid-cleaving activity is directed by a guide DNA, and wherein the RHDC polypeptide is fused to the nucleic nucleic acid unwinding polypeptide.

In some embodiments, the present disclosure provides a polypeptide construct comprising an Argonaute polypeptide and a nucleic acid unwinding polypeptide, wherein the Argonaute polypeptide cleaves a nucleic acid at a mesophilic temperature.

In some embodiments, the present disclosure provides a method of genome editing comprising introducing into a cell: (a) an RNase-H-like domain-containing (RHDC) polypeptide; (b) a nucleic acid unwinding agent; and (c) a guide DNA, wherein the guide DNA comprises a sequence that is complementary to at least a portion of a target nucleic acid sequence in the cell, wherein the nucleic acid unwinding agent unwinds at least a portion of the target sequence, and wherein the RHDC polypeptide introduces a genomic disruption into the target sequence at a mesophilic temperature.

In some embodiments, the present disclosure provides a method of genome editing comprising introducing into a cell: (a) an Argonaute polypeptide; (b) a nucleic acid unwinding agent; and (c) a guide polynucleic acid, wherein the guide polynucleic acid comprises a sequence that is complementary to at least a portion of a target nucleic acid sequence in the cell, wherein the nucleic acid unwinding agent unwinds at least a portion of the target sequence, and wherein the Argonaute polypeptide introduces a genomic disruption into the target sequence at a mesophilic temperature.

In some embodiments, the method further comprises introducing into the cell an exogenous nucleic acid sequence. In some embodiments, the exogenous nucleic acid sequence is introduced into a genomic disruption. In some embodiments, the exogenous nucleic acid sequence is introduced into a random genomic location. In some embodiments, the exogenous nucleic acid sequence is introduced via non-viral introduction or viral introduction. In some embodiments, the viral introduction comprises a retrovirus, lentivirus, adenovirus, or adeno-associated virus. In some embodiments, the non-viral introduction of the exogenous nucleic acid sequence comprises an electroporation, microinjection, liposome, or conjugation. In some embodiments, the exogenous nucleic acid sequence is DNA or RNA. In some embodiments, the exogenous nucleic acid sequence is single stranded DNA or double stranded DNA. In some embodiments, the exogenous nucleic acid sequence comprises double stranded DNA it comprises plasmid DNA or minicircle DNA. In some embodiments, the exogenous nucleic acid sequence encodes an exogenous receptor.

In some embodiments, the method comprises stimulating the cell prior to, concurrent with, or after the introducing. In some embodiments, the cell is stimulated prior to the introducing. In some embodiments, the cell is stimulated from about 1 hour to about 48 hours prior to the introducing. In some embodiments, the stimulation comprises contacting the cell with at least one of: an anti-CD3 antibody, an anti-CD28 antibody, or an interleukin. In some embodiments, the introducing comprises at least one of electroporation, microinjection, liposome, or conjugation. In some embodiments, the introducing comprises electroporation. In some embodiments, the electroporation comprises introducing the Argonaute polypeptide, the nucleic acid unwinding agent, the guiding polynucleic acid, or a combination thereof, at a voltage from about 1000 V to about 2000V for about 1 ms to about 30 ms. In some embodiments, the voltage is from about 1400V for about 10 ms. In some embodiments, the electroporation comprises about 1 pulse to about 5 pulses. In some embodiments, the electroporation is 3 pulses.

In some embodiments, the method further comprises expanding the cells. In some embodiments, the method further comprises selecting one or more of the cells. In some embodiments, the selection comprises at least one of a magnetic separation, a flow cytometric separation, and/or an antibiotic. In some embodiments, the selection comprises selecting a population of cells that express a cellular marker or an exogenous receptor. In some embodiments, the cellular marker comprises at least one of: CD3, CD4, CD8, CCR7, CD45RA, CD62L+, CD27, CD28, and IL-7Rα. In some embodiments, the method is performed in a closed system. In some embodiments, the method further comprises repeating the method on the cells.

In some embodiments, the polypeptide comprises at least one RHDC polypeptide and a nucleic acid unwinding polypeptide. In some embodiments, the at least one RHDC polypeptide and the nucleic acid unwinding polypeptide are derived from a mesophilic organism.

In some embodiments, the polypeptide comprises at least one Argonaute polypeptide and a nucleic acid unwinding polypeptide. In some embodiments, the at least one Argonaute polypeptide and the nucleic acid unwinding polypeptide are derived from a mesophilic organism.

In one embodiment, the present disclosure provides an ex vivo system for use in targeting a predetermined gene, the system comprising an RNase-H-like domain-containing (RHDC) polypeptide, a nucleic acid unwinding agent, and a guide DNA (gDNA), wherein the gDNA binds to the gene or to a nucleic acid sequence adjacent to the gene, and wherein the RHDC polypeptide cleaves a nucleic acid at a mesophilic temperature, wherein the nucleic acid-cleaving activity is directed by a guide DNA.

In one embodiment, the present disclosure provides an ex vivo system for use in targeting a predetermined gene, the system comprising an Argonaute polypeptide and a nucleic acid unwinding agent, wherein the Argonaute polypeptide cleaves a nucleic acid at a mesophilic temperature.

In some embodiments, the ex vivo system further comprises a cell.

In some embodiments, the ex vivo system for use in targeting a predetermined gene, comprises at least one RHDC polypeptide and a nucleic acid unwinding polypeptide. In some embodiments, the at least one RHDC polypeptide and the nucleic acid unwinding polypeptide are derived from a mesophilic organism.

In some embodiments, the ex vivo system for use in targeting a predetermined gene, comprises at least one Argonaute polypeptide and a nucleic acid unwinding polypeptide. In some embodiments, the at least one Argonaute polypeptide and the nucleic acid unwinding polypeptide are derived from a mesophilic organism.

In some embodiments, the RHDC polypeptide cleaves a nucleic acid from about 30° C. to about 39° C. In some embodiments, the RHDC polypeptide cleaves a nucleic acid from about 35° C. to about 39° C. In some embodiments, the RHDC polypeptide cleaves a nucleic acid at 37° C. In some embodiments, the RHDC polypeptide demonstrates nuclease activity from 5° C. to 40° C.

In some embodiments, the Argonaute polypeptide cleaves a nucleic acid from about 30° C. to about 39° C. In some embodiments, the Argonaute polypeptide cleaves a nucleic acid from about 35° C. to about 39° C. In some embodiments, the Argonaute polypeptide cleaves a nucleic acid at 37° C. In some embodiments, the Argonaute polypeptide demonstrates nuclease activity from 5° C. to 40° C.

In some embodiments, the mesophilic organism is a prokaryotic organism. In some embodiments, the mesophilic organism is from a family selected from the group consisting of: bacteroidetes, proteobacteria, actinobacteria, firmicutes, cyanobacteria, spirochaetes, deinococcus, verrucomicrobia, planctomycetes, balneolaeota, and chloroflexi. In some embodiments, the mesophilic organism is from a family selected from the group consisting of: proteobacteria, acidobacteria, actinobacteria, and bacteroidetes.

In some embodiments, the RHDC polypeptide is an archaeal Argonaute polypeptide. In some embodiments, the Argonaute polypeptide is an archaeal Argonaute polypeptide.

In some embodiments, the RHDC polypeptide is encoded by a gene located in an adjacent operon to at least one of a P-element induced WImpy testis (PIWI) gene, RuvC, Cas, Sir2, Mrr, TIR, PLD, REase, restriction endonuclease, DExD/H, superfamily II helicase, RRXRR, DUF460, DUF3010, DUF429, DUF1092, COG5558, OrfB_IS605, Peptidase_A17, Ribonuclease H-like domain, 3'-5' exonuclease domain, 3'-5' exoribonuclease Rv2179c-like domain, Bacteriophage Mu, transposase, DNA-directed DNA polymerase, family B, exonuclease domain, Exonuclease, RNase T/DNA polymerase III, yqgF gene, HEPN, RNase LS domain, LsoA catalytic domain, KEN domain, RNaseL, Irel, RNase domain, RloC, or PrrC.

In some embodiments, the RHDC polypeptide is encoded by a gene located in an adjacent operon to at least one of a gene involved in defense, stress response, a CRISPR system, or DNA repair.

In some embodiments, the RHDC polypeptide comprises an Argonaute domain. In some embodiments, the RHDC polypeptide has nuclease activity. In some embodiments, the Argonaute polypeptide has nuclease activity. In some embodiments, the nuclease activity is double stranded DNA cleaving activity.

In some embodiments, the RHDC polypeptide has nickase activity. In some embodiments, the Argonaute polypeptide has nickase activity. In some embodiments, the nickase activity is single stranded DNA cleaving activity.

In some embodiments, the RHDC polypeptide has RNAse activity. In some embodiments, the Argonaute polypeptide has RNase activity. In some embodiments, the RNase activity is double stranded RNA cleaving activity. In some embodiments, the RNase activity is RNA cleaving activity.

In some embodiments, the RHDC polypeptide has RNase-H activity. In some embodiments, the Argonaute polypeptide has RNase-H activity. In some embodiments, the RNase-H activity is RNA cleaving activity.

In some embodiments, the RHDC polypeptide has recombinase activity. In some embodiments, the RHDC polypeptide has DNA base flipping activity. In some embodiments, the RHDC polypeptide has transposase activity.

In some embodiments, the nucleic acid unwinding polypeptide is of prokaryotic origin. In some embodiments, the nucleic acid unwinding polypeptide is of archaeal origin.

In some embodiments, the nucleic acid unwinding polypeptide comprises a helicase domain. In some embodiments, the nucleic acid unwinding polypeptide comprises a topoisomerase domain. In some embodiments, the nucleic acid unwinding polypeptide comprises a Cas protein domain. In some embodiments, the Cas protein domain is selected from the group consisting of: Cas1, Cas1B, Cast, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, and Cas9HiFi.

In some embodiments, the nucleic acid unwinding polypeptide comprises a catalytically dead nucleic acid unwinding domain. In some embodiments, the catalytically dead nucleic acid unwinding domain is a dCas domain. In some embodiments, the catalytically dead nucleic acid unwinding domain is a dCas9 domain.

In some embodiments, the nucleic acid unwinding polypeptide comprises an ATPase domain. In some embodiments, the nucleic acid unwinding polypeptide has ATPase activity. In some embodiments, In some embodiments, the polypeptide construct comprises a polypeptide with ATPase activity. In some embodiments, the ex vivo system comprises a functional ATPase domain.

In some embodiments, the RHDC polypeptide and the nucleic acid unwinding polypeptide are joined by a linker. In some embodiments, the Argonaute polypeptide and the nucleic acid unwinding polypeptide are joined by a linker. In some embodiments, the linker is a polypeptide linker.

In some embodiments, the nucleic acid unwinding polypeptide and the RHDC polypeptide are expressed in the same frame. In some embodiments, the nucleic acid unwinding polypeptide and the Argonaute polypeptide are expressed in the same frame.

In some embodiments, the polypeptide construct is bound to the guide DNA. In some embodiments, the polypeptide construct comprising an RNase-H-like domain-containing (RHDC) polypeptide and a nucleic acid unwinding polypeptide construct is bound to the guide DNA.

In some embodiments, the at least one of the RHDC polypeptide and the nucleic acid unwinding agent is bound to a guide DNA.

In some embodiments, the polypeptide construct is bound to a guide nucleic acid. In some embodiments, the polypeptide construct comprising an Argonaute polypeptide and a nucleic acid unwinding polypeptide is bound to a guide nucleic acid.

In some embodiments, the guide polynucleic acid is a guide DNA (gDNA). In some embodiments, the guide DNA is from about 1 base pair to about 30 base pairs. In some embodiments, the guide DNA forms a secondary structure. In some embodiments, the guide DNA is complementary to a target polynucleotide sequence. In some embodiments, the target polynucleotide sequence is a gene sequence. In some embodiments, the gene sequence is a sequence of a disease-associated gene.

In some embodiments, the guide nucleic acid is a guide RNA (gRNA).

In some embodiments, the guide polynucleic acid is from about 1 base pair to about 30 base pairs. In some embodiments, the guide polynucleic acid forms a secondary structure. In some embodiments, the guide polynucleic acid is complementary to a target polynucleotide sequence. In some embodiments, the target polynucleotide sequence is a gene sequence. In some embodiments, the gene sequence is a sequence of a disease-associated gene. In some embodiments, the polypeptide construct produces a disruption when introduced into a cell. In some embodiments, the ex vivo system produces a disruption when introduced to a cell.

In some embodiments, the disruption comprises a double strand break or a single strand break. In some embodiments, the cell is a prokaryotic cell. In some embodiments, the cell is a eukaryotic cell. In some embodiments, the eukaryotic cell is a plant cell. In some embodiments, the eukaryotic cell is an animal cell. In some embodiments, the animal cell is a mammalian cell. In some embodiments, the mammalian cell is a human cell. In some embodiments, the human cell is a stem cell. In some embodiments, the human cell is an immune cell. In some embodiments, the immune cell is a lymphoid cell. In some embodiments, the lymphoid cell is a T cell, B cell, NK cell, stem cell, or TIL. In some embodiments, the cell is a primary cell.

In some embodiments, the polypeptide construct is good-manufacturing practices (GMP) compatible. In some embodiments, the ex vivo system is good-manufacturing practices (GMP) compatible.

In some embodiments, the present disclosure provides an ex vivo cell comprising any one of the polypeptide constructs disclosed herein.

In some embodiments, the present disclosure provides an ex vivo cell comprising a polypeptide construct comprising an RNase-H-like domain-containing (RHDC) polypeptide and a nucleic acid unwinding polypeptide, wherein the RHDC polypeptide cleaves a nucleic acid at a mesophilic temperature, wherein the nucleic acid-cleaving activity is directed by a guide DNA, and wherein the RHDC polypeptide is fused to the nucleic nucleic acid unwinding polypeptide.

In some embodiments, the present disclosure provides an ex vivo cell comprising a polypeptide construct comprising an Argonaute polypeptide and a nucleic acid unwinding polypeptide, wherein the Argonaute polypeptide cleaves a nucleic acid at a mesophilic temperature.

In some embodiments, the ex vivo cell is a primary cell. In some embodiments, the ex vivo cell is a recombinant cell. In some embodiments, the ex vivo cell is a prokaryotic cell. In some embodiments, the ex vivo cell is a eukaryotic cell. In some embodiments, the eukaryotic cell is a plant cell. In some embodiments, the eukaryotic cell is an animal cell. In some embodiments, the animal cell is a mammalian cell. In some embodiments, the mammalian cell is a human cell. In some embodiments, the human cell is a stem cell. In some embodiments, the human cell is an immune cell. In some embodiments, the immune cell is a lymphoid cell. In some embodiments, the lymphoid cell is a T cell, B cell, NK cell, stem cell, or TIL. In some embodiments, the cell is a primary cell.

In some embodiments, the present disclosure provides a polynucleic acid encoding any one of the polypeptide constructs disclosed herein.

In some embodiments, the present disclosure provides a polynucleic acid encoding a polypeptide construct comprising an RNase-H-like domain-containing (RHDC) polypeptide and a nucleic acid unwinding polypeptide, wherein the RHDC polypeptide cleaves a nucleic acid at a mesophilic temperature, wherein the nucleic acid-cleaving activity is directed by a guide DNA, and wherein the RHDC polypeptide is fused to the nucleic nucleic acid unwinding polypeptide.

In some embodiments, the present disclosure provides a polynucleic acid encoding a polypeptide construct comprising an Argonaute polypeptide and a nucleic acid unwinding polypeptide, wherein the Argonaute polypeptide cleaves a nucleic acid at a mesophilic temperature.

In some embodiments, the RHDC polypeptide and the nucleic acid unwinding polypeptide are in the same reading frame.

In some embodiments, the polynucleic acid further comprises a nuclear localization signal.

In some embodiments, the present disclosure provides a pharmaceutical composition comprising: (a) any one of the polypeptide constructs disclosed herein or any one of the ex vivo systems disclosed herein; and (b) at least one of: an excipient, a diluent, or a carrier.

In some embodiments, the pharmaceutical composition is in unit dosage form.

In some embodiments, the pharmaceutical composition is in the form of a tablet, a liquid, syrup, an oral formulation, an intravenous formulation, an intranasal formulation, a subcutaneous formulation, an inhalable respiratory formulation, a suppository, and any combination thereof.

In some embodiments, the present disclosure provides a kit comprising: (a) any one of the polypeptide constructs disclosed herein or any one of the ex vivo systems disclosed herein; and (b) instructions for use thereof.

In some embodiments, the kit further comprises a container.

In some embodiments, the present disclosure provides a method of treating a subject in need thereof, comprising administering a population of cells modified with any one of the methods disclosed herein. In some embodiments, the method further comprises administering at least one of a cytokine, chemotherapeutic, anti-viral, antibiotic, or granulocyte colony-stimulating factor (G-CSF) analog. In some embodiments, the cytokine is IL-2. In some embodiments, a cancer is reduced in the subject in need thereof after the administering as measured by CT scan.

In some embodiments, the present disclosure provides an ex vivo system comprising an RNase H-like domain-containing (RHDC) polypeptide, a nucleic acid unwinding agent, and a guide nucleic acid, wherein the guide nucleic acid binds to a predetermined gene or to a nucleic acid sequence adjacent to the predetermined gene, the RHDC polypeptide is capable of introducing a double strand break in the predetermined gene, the nucleic acid unwinding agent lowers the energetic requirement for introducing the double strand break in comparison to introducing a double strand break with the RHDC polypeptide alone, and the ex vivo system introduces the double strand break at a range of temperatures from 19° C. to 40° C. In some embodiments the ex vivo system further comprises a regulatory domain polypeptide (RDP).

In some embodiments, provided herein is an ex vivo system comprising an RNase H-like domain-containing (RHDC) polypeptide, a nucleic acid unwinding agent, a guide nucleic acid, and a regulatory domain polypeptide (RDP), wherein the guide nucleic acid binds to a predetermined gene or to a nucleic acid sequence adjacent to the predetermined gene, the RHDC polypeptide is capable of introducing a double strand break in the predetermined gene, the nucleic acid unwinding agent lowers the energetic requirement for introducing the double strand break in comparison to introducing a double strand break with the RHDC alone, and the ex vivo system introduces the double strand break at a range of temperatures from 19° C. to 40° C. In some embodiments the nucleic acid unwinding agent is a polypeptide. In some embodiments the RHDC polypeptide, the nucleic acid unwinding agent, and the RDP are a polypeptide construct. In some cases, the RDP is a Rad51 polypeptide or a recombinase. In some cases, the guide nucleic acid is a guide DNA. In some cases, the ex vivo system introduces a double strand break in the predetermined gene at an efficiency 25%, 50%, or 75% greater than a comparable ex vivo system without said nucleic acid unwinding agent. In some cases, the ex vivo system introduces a first D-loop in the predetermined gene at an efficiency of 25%, 50%, or 75% and a second D-loop in said predetermined nucleic acid sequence at an efficiency of 25%, 50%, or 75%. In some cases, the RHDC polypeptide is an Argonaute polypeptide. In some cases, the Argonaute is selected from the group consisting of MjAgo, TtAgo, HlaAgo, DmcAgo, MsAgo, TsAgo, and PfAgo.

In some embodiments, provided herein is a cell comprising an ex vivo system.

In some embodiments, provided herein is a composition comprising an ex vivo system.

In some embodiments, provided herein is a polypeptide construct comprising an RNAse H-like domain-containing (RHDC) polypeptide and a regulatory domain polypeptide (RDP). In some cases, the polypeptide construct further comprises a nucleic acid unwinding domain. In some cases, the nucleic acid unwinding domain is a dCas9 domain. In some cases, the polypeptide construct further comprises a regulatory domain polypeptide (RDP). In some cases, the RDP is a Rad51 polypeptide or a recombinase.

Provided herein is a cell comprising a polypeptide construct.

Provided herein is a composition comprising a polypeptide construct.

Provided herein is a method for reducing an energy requirement associated with a nucleic acid editing system, comprising contacting a cell with a nucleic acid editing system, wherein the nucleic acid editing system comprises an RNase H-like domain-containing (RHDC) polypeptide, a nucleic acid unwinding agent, a guide nucleic acid, and a regulatory domain polypeptide (RDP), wherein the energy required for nucleic acid editing with said nucleic acid editing system is less than a comparable nucleic acid editing system without the RDP.

Provided herein is an Assembled Genetic Editing Molecule (AGEM) comprising an RNase H-like domain-containing (RHDC) polypeptide, a nucleic acid unwinding polypeptide, and an optional regulatory domain polypeptide (RDP), wherein the RHDC polypeptide cleaves a nucleic acid at a mesophilic temperature, wherein said nucleic acid-cleaving activity is directed by a guide nucleic acid, and wherein said RHDC polypeptide is fused to said nucleic acid unwinding polypeptide. In some cases, the RHDC polypeptide is an Argonaute polypeptide. In some cases, the Argonaute is selected from the group consisting of MjAgo, TtAgo, HlaAgo, DmcAgo, MsAgo, TsAgo, and PfAgo. In some cases, the RHDC polypeptide comprises a sequence selected from the group consisting of SEQ ID NOs: 59-160. In some cases, the RDP is a Rad51 polypeptide or a recombinase. In some cases, the nucleic acid unwinding polypeptide comprises a dCas9 domain.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 3 shows features of the PIWI superfamily proteins, including that C-termini may contain a PIWI domain and be conserved among nucleases. Dotted lines indicate separate genes located in the same, predicted, operon.

FIG. 5 shows a C-terminus structural alignment. Red is matching alpha helix, blue is beta sheet. FIG. 5 discloses SEQ ID NOS 385-406, respectively, in order of appearance.

FIGS. 8A-8D show a phylogenetic tree. On the right is homology between predicted structural alignments. From left to right is position 0 to end of protein. Black boxes are conserved domains.

FIG. 22A shows a negative control experiment performed using HEK293T cells.

FIG. 22B shows a negative control experiment performed using 6808 cells.

FIG. 22C shows a negative control experiment performed using 6808 cells and Cas9.

FIG. 22D shows a negative control experiment performed using 6808 cells, Cas9 and a non-targeting guide RNA.

FIG. 22E shows a negative control experiment performed using 6808 cells, Cas9, a non-targeting guide RNA and a single-stranded oligodeoxynucleotide donor.

FIG. 22F shows a negative control experiment performed using 6808 cells, Cas9, a non-targeting guide RNA and another single-stranded oligodeoxynucleotide donor.

FIG. 22J shows a negative control experiment performed using 6808 cells and a single-stranded oligodeoxynucleotide donor.

FIG. 22K shows a negative control experiment performed using 6808 cells and a single-stranded oligodeoxynucleotide donor.

FIG. 33 shows the first law of genetic thermodynamics and provides a comparison between the AGEM system provided herein (exothermic) and additional gene editing systems (endothermic).

DETAILED DESCRIPTION OF THE INVENTION

Figure 1:
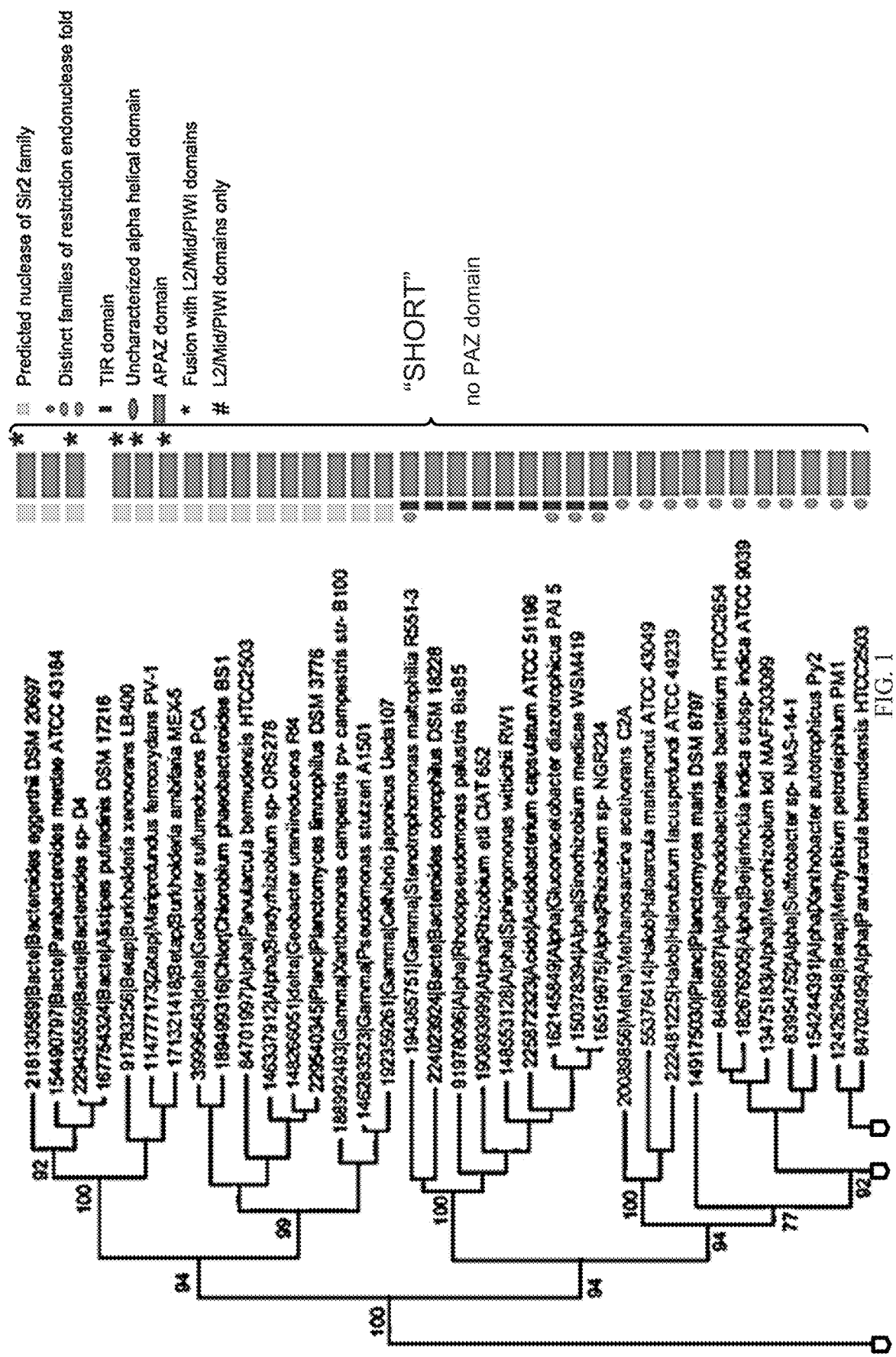
FIG. 1 shows a phylogenetic tree for a PIWI domain in a complete genome of an Argonaute protein. This tree identifies possible PIWI domains in organisms that can be used to identify suitable nuclease or helicase domains.
Figure 1:
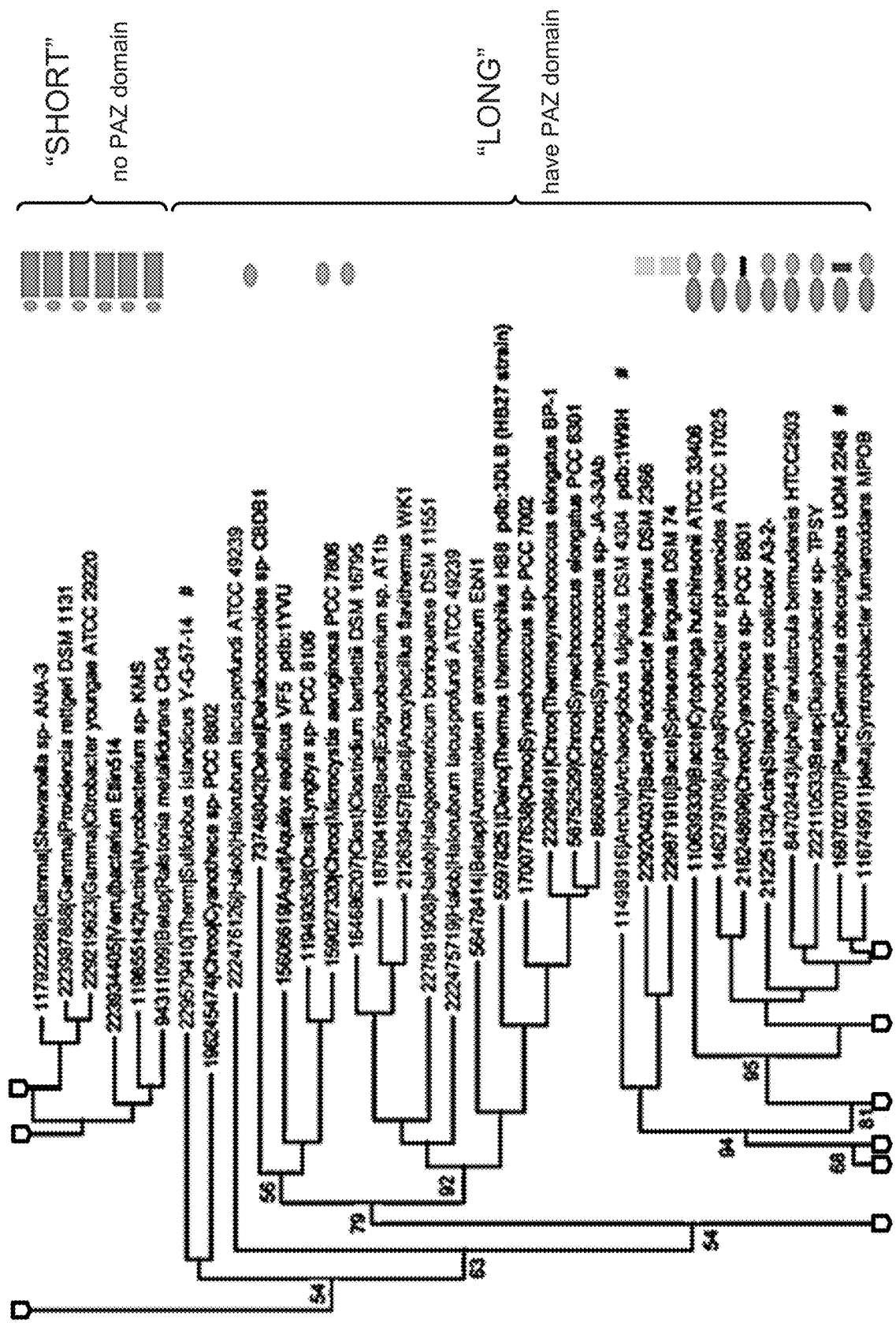
Figure 1:
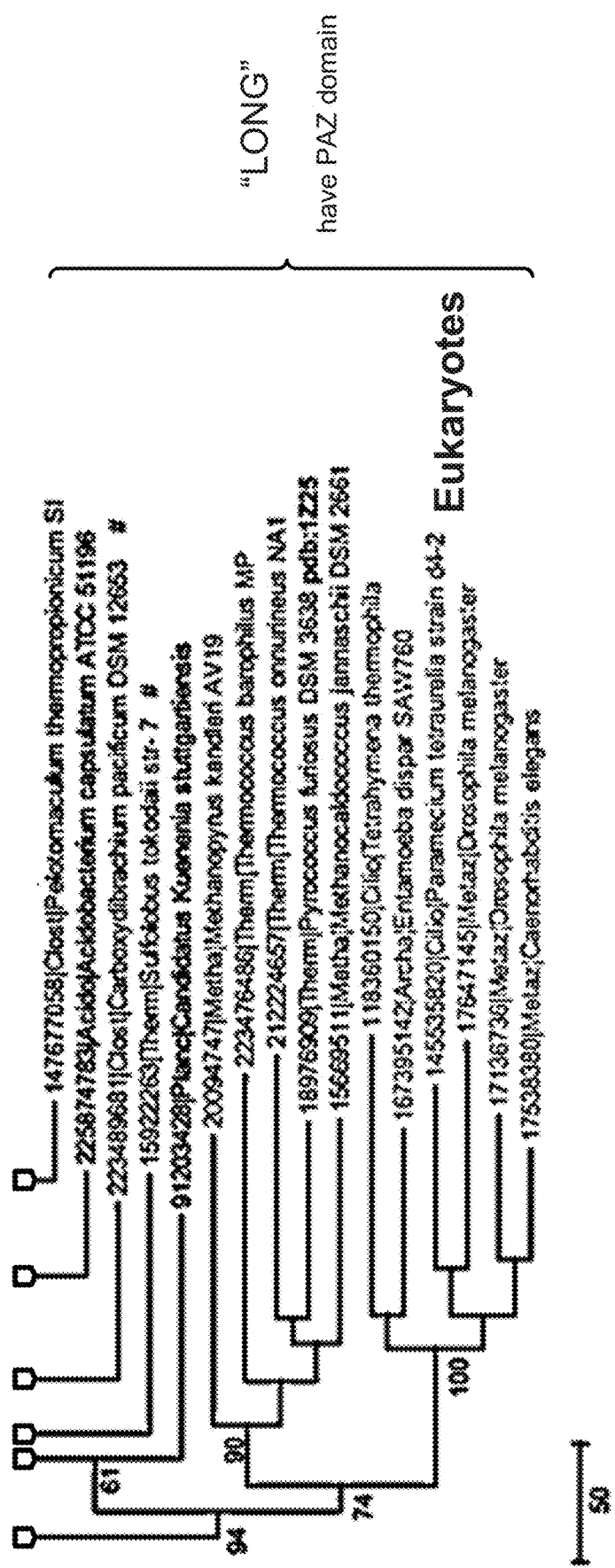

The following description and examples illustrate embodiments of the invention in detail. It is to be understood that this invention is not limited to the particular embodiments described herein and as such can vary. Those of skill in the art will recognize that there are numerous variations and modifications of this invention, which are encompassed within its scope.

Definitions

The term "about" and its grammatical equivalents in relation to a reference numerical value and its grammatical equivalents as used herein can include a range of values plus or minus 10% from that value. For example, the amount "about 10" includes amounts from 9 to 11. The term "about" in relation to a reference numerical value can also include a range of values plus or minus 10%, 9%, 8%, 7%, 6%, 5%, 4%, 3%, 2%, or 1% from that value.

The term "activation" and its grammatical equivalents as used herein can refer to a process whereby a cell transitions from a resting state to an active state. This process can comprise a response to an antigen, migration, and/or a phenotypic or genetic change to a functionally active state. For example, the term "activation" can refer to the stepwise process of T cell activation. For example, a T cell can require at least two signals to become fully activated. The first signal can occur after engagement of a TCR by the antigen-MHC complex, and the second signal can occur by engagement of co-stimulatory molecules. Anti-CD3 can mimic the first signal and anti-CD28 can mimic the second signal in vitro.

The term "adjacent" and its grammatical equivalents as used herein can refer to right next to the object of reference. For example, the term adjacent in the context of a nucleotide sequence can mean without any nucleotides in between. For instance, polynucleotide A adjacent to polynucleotide B can mean AB without any nucleotides in between A and B.

The term "argonuate," "Ago," and its grammatical equivalents as used herein can refer to a naturally occurring or engineered domain or protein that can be guided by guiding polynucleic acid to specifically recognize a target nucleic acid comprising a complementary sequence to the guiding polynucleic acid. Some Ago domains or proteins, also referred to herein as "Argonaute nucleases" have endonuclease activity, e.g., the ability to cleave an internal phosphodiester bond in a target nucleic acid. Some Ago proteins may not cleave a target nucleic acid.

The term "autologous" and its grammatical equivalents as used herein can refer to as originating from the same being. For example, a sample (e.g., cells) can be removed, processed, and given back to the same subject (e.g., subject) at a later time. An autologous process is distinguished from an allogenic process where the donor and the recipient are different subjects.

The term "cancer" and its grammatical equivalents as used herein can refer to a hyperproliferation of cells whose unique trait—loss of normal controls—results in unregulated growth, lack of differentiation, local tissue invasion, and/or metastasis. With respect to the inventive methods, the cancer can be any cancer, including any of acute lymphocytic cancer, acute myeloid leukemia, alveolar rhabdomyosarcoma, bladder cancer, bone cancer, brain cancer, breast cancer, cancer of the anus, anal canal, rectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia, chronic myeloid cancer, colon cancer, esophageal cancer, cervical cancer, fibrosarcoma, gastrointestinal carcinoid tumor, Hodgkin lymphoma, hypopharynx cancer, kidney cancer, larynx cancer, leukemia, liquid tumors, liver cancer, lung cancer, lymphoma, malignant mesothelioma, mastocytoma, melanoma, multiple myeloma, nasopharynx cancer, non-Hodgkin lymphoma, ovarian cancer, pancreatic cancer, peritoneum, omentum, and mesentery cancer, pharynx cancer, prostate cancer, rectal cancer, renal cancer, skin cancer, small intestine cancer, soft tissue cancer, solid tumors, stomach cancer, testicular cancer, thyroid cancer, ureter cancer, and/or urinary bladder cancer. As used herein, the term "tumor" refers to an abnormal growth of cells or tissues, e.g., of malignant type or benign type.

The term "cancer neo-antigen" or "neo-antigen" or "neo-epitope" and its grammatical equivalents as used herein can refer to antigens that are not expressed and/or not exposed to immune surveillance in normal, non-cancerous host tissue. For example, a "neo-antigen" may not be encoded in a normal, non-mutated host genome. A "neo-antigen" can in some instances represent either oncogenic viral proteins or abnormal proteins that arise as a consequence of somatic mutations. For example, a neo-antigen can arise by the disruption of cellular mechanisms through the activity of viral proteins. Another example can be an exposure of a carcinogenic compound, which in some cases can lead to a somatic mutation. This somatic mutation can ultimately lead to the formation of a tumor/cancer.

The term "cytotoxicity" as used in this specification, refers to an alteration in the normal state of a cell such that the cell dies. The normal state of a cell can refer to a state that is manifested or exists prior to the cell's exposure to a cytotoxic composition, agent and/or condition. Generally, a cell that is in a normal state is one that is in homeostasis. An unintended or undesirable alteration in the normal state of a cell can be manifested in the form of, for example, cell death (e.g., programmed cell death), a decrease in replicative potential, a decrease in cellular integrity such as membrane integrity, a decrease in metabolic activity, a decrease in developmental capability, or any of the cytotoxic effects disclosed in the present application. Cytotoxicity can be desirable, for example, in the case of tumor cell cytotoxicity, or undesirable, for example, in the case of healthy cell cytotoxicity.

The phrase "reducing cytotoxicity" or "reduce cytotoxicity" refers to a reduction in degree or frequency of unintended or undesirable alterations in the normal state of a cell upon exposure to a cytotoxic composition, agent and/or condition. The phrase can refer to reducing the degree of cytotoxicity in an individual cell that is exposed to a cytotoxic composition, agent and/or condition, or to reducing the number of cells of a population that exhibit cytotoxicity when the population of cells is exposed to a cytotoxic composition, agent and/or condition.

The term "engineered" and its grammatical equivalents as used herein can refer to one or more alterations of a nucleic acid, e.g., the nucleic acid within an organism's genome. The term "engineered" can refer to alterations, additions, and/or deletion of genes. An engineered cell can also refer to a cell with an added, deleted and/or altered gene.

The term "cell" or "engineered cell" and their grammatical equivalents as used herein can refer to a cell of human or non-human animal origin.

The term "checkpoint gene" and its grammatical equivalents as used herein can refer to any gene that is involved in an inhibitory process (e.g., feedback loop) that acts to regulate the amplitude of an immune response, for example, an immune inhibitory feedback loop that mitigates uncontrolled propagation of harmful responses. These responses can include contributing to a molecular shield that protects against collateral tissue damage that might occur during immune responses to infections and/or maintenance of peripheral self-tolerance. Non-limiting examples of checkpoint genes can include members of the extended CD28 family of receptors and their ligands as well as genes involved in co-inhibitory pathways (e.g., CTLA-4 and PD-1). The term "checkpoint gene" can also refer to an immune checkpoint gene.

A "CRISPR," "CRISPR system," or "CRISPR nuclease system" and their grammatical equivalents can include an RNA molecule (e.g., guide RNA) that binds to DNA and a Cas protein (e.g., Cas9) with nuclease functionality (e.g., two nuclease domains). See, e.g., Sander, J. D., et al., "CRISPR-Cas systems for editing, regulating and targeting genomes," Nature Biotechnology, 32:347-355 (2014); see also e.g., Hsu, P. D., et al., "Development and applications of CRISPR-Cas9 for genome engineering," Cell 157(6): 1262-1278 (2014). In some embodiments, a CRISPR system includes a Cas protein with nickase functionality (e.g., one catalytically dead nuclease domain and one catalytically active nuclease domain) A Cas can be partially catalytically dead.

The term "disrupting" and its grammatical equivalents as used herein can refer to a process of altering a gene, e.g., by deletion, insertion, mutation, rearrangement, or any combination thereof. For example, a gene can be disrupted by knockout. Disrupting a gene can, for example, partially or completely suppress expression of the gene. Disrupting a gene can also cause activation of a different gene, for example, a downstream gene.

The term "engineered" and its grammatical equivalents as used herein can refer to one or more alterations of a nucleic acid, e.g., the nucleic acid within an organism's genome. The term "engineered" can refer to alterations, additions, and/or deletion of genes. An engineered cell can also refer to a cell with an added, deleted and/or altered gene.

The term "function" and its grammatical equivalents as used herein can refer to the capability of operating, having, or serving an intended purpose. Functional can comprise any percent from baseline to 100% of normal function. For example, functional can comprise or comprise about 5, 10, 15, 20, 25, 30, 35, 40, 45, 50, 55, 60, 65, 70, 75, 80, 85, 90, 95, and/or 100% of normal function. In some cases, the term functional can mean over or over about 100% of normal function, for example, 125, 150, 175, 200, 250, 300% and/or above normal function.

The term "gene editing" and its grammatical equivalents as used herein can refer to genetic engineering in which one or more nucleotides are inserted, replaced, or removed from a genome. Gene editing can be performed using a nuclease (e.g., a natural-existing nuclease or an artificially engineered nuclease).

The term "good manufacturing practices" (GMP) and its grammatical equivalents as used herein can refer to products that are safe, effective, or pure according to the FDA. GMP can also sometimes be referred to as "cGMP". The "c" stands for "current." Manufacturers of a product can employ technologies and systems which are up-to-date in order to comply with regulation of GMP products. GMP compatible products are typically utilized in the clinical setting as opposed to the research setting.

The term "mutation" and its grammatical equivalents as used herein can include the substitution, deletion, and insertion of one or more nucleotides in a polynucleotide. For example, up to 1, 2, 3, 4, 5, 6, 7, 8, 9, 10, 11, 12, 13, 14, 15, 20, 25, 30, 40, 50, or more nucleotides/amino acids in a polynucleotide (cDNA, gene) or a polypeptide sequence can be substituted, deleted, and/or inserted. A mutation can affect the coding sequence of a gene or its regulatory sequence. A mutation can also affect the structure of the genomic sequence or the structure/stability of the encoded mRNA.

The term "non-human animal" and its grammatical equivalents as used herein can include all animal species other than humans, including non-human mammals, which can be a native animal or a genetically modified non-human animal.

The terms "nucleic acid," "polynucleotide," "polynucleic acid," and "oligonucleotide" and their grammatical equivalents can be used interchangeably and can refer to a deoxyribonucleotide or ribonucleotide polymer, in linear or circular conformation, and in either single- or double-stranded form. For the purposes of the present disclosure, these terms should not to be construed as limiting with respect to length, unless the context clearly indicates otherwise. The terms can also encompass analogues of natural nucleotides, as well as nucleotides that are modified in the base, sugar and/or phosphate moieties (e.g., phosphorothioate backbones). Modifications of the terms can also encompass demethylation, addition of CpG methylation, removal of bacterial methylation, and/or addition of mammalian methylation. In general, an analogue of a particular nucleotide can have the same base-pairing specificity, e.g., an analogue of A can base-pair with T.

The term "construct" can refer to an artificial or synthetic construct. For example, a polypeptide construct can refer to an artificial or synthetic polypeptide, e.g., comprising one or more polypeptide sequences. Similarly, a nucleic acid construct can refer to an artificial or synthetic nucleic acid, e.g., comprising one or more nucleic acid sequences.

The term "percent (%) identity" can be readily determined for nucleic acid or amino acid sequences, over the full-length of a sequence, or a fragment thereof. Generally, when referring to "identity", "homology", or "similarity" between two different sequences (e.g., nucleotide or amino acid sequences), "identity", "homology" or "similarity" is determined in reference to "aligned" sequences. "Aligned" sequences or "alignments" refer to multiple nucleic acid sequences or protein (amino acids) sequences, often containing corrections for missing or additional bases or amino acids as compared to a reference sequence.

The term "peripheral blood lymphocytes" (PBL) and its grammatical equivalents as used herein can refer to lymphocytes that circulate in the blood (e.g., peripheral blood). Peripheral blood lymphocytes can refer to lymphocytes that are not localized to organs. Peripheral blood lymphocytes can comprise T cells, NK cells, B cell, or any combinations thereof.

The term "phenotype" and its grammatical equivalents as used herein can refer to a composite of an organism's observable characteristics or traits, such as its morphology, development, biochemical or physiological properties, phenology, behavior, and/or products of behavior. Depending on the context, the term "phenotype" can sometimes refer to a composite of a population's observable characteristics or traits.

The term "protospacer" and its grammatical equivalents as used herein can refer to a PAM-adjacent nucleic acid sequence capable to hybridizing to a portion of a guide RNA, such as the spacer sequence or engineered targeting portion of the guide RNA. A protospacer can be a nucleotide sequence within gene, genome, or chromosome that is targeted by a guide RNA. In the native state, a protospacer is adjacent to a PAM (protospacer adjacent motif). The site of cleavage by an RNA-guided nuclease is within a protospacer sequence. For example, when a guide RNA targets a specific protospacer, the Cas protein will generate a double strand break within the protospacer sequence, thereby cleaving the protospacer. Following cleavage, disruption of the protospacer can result though non-homologous end joining (NHEJ) or homology-directed repair (HDR). Disruption of the protospacer can result in the deletion of the protospacer. Additionally or alternatively, disruption of the protospacer can result in an exogenous nucleic acid sequence being inserted into or replacing the protospacer.

The term "recipient" and their grammatical equivalents as used herein can refer to a human or non-human animal. The recipient can also be in need thereof.

The term "recombination" and its grammatical equivalents as used herein can refer to a process of exchange of genetic information between two polynucleic acids. For the purposes of this disclosure, "homologous recombination" or "HR" can refer to a specialized form of such genetic exchange that can take place, for example, during repair of double-strand breaks. This process can require nucleotide sequence homology, for example, using a donor molecule to template repair of a target molecule (e.g., a molecule that experienced the double-strand break), and is sometimes known as non-crossover gene conversion or short tract gene conversion. Such transfer can also involve mismatch correction of heteroduplex DNA that forms between the broken target and the donor, and/or synthesis-dependent strand annealing, in which the donor can be used to resynthesize genetic information that can become part of the target, and/or related processes. Such specialized HR can often result in an alteration of the sequence of the target molecule such that part or all of the sequence of the donor polynucleotide can be incorporated into the target polynucleotide. In some cases, the terms "recombination arms" and "homology arms" can be used interchangeably.

The term "RNase-H-like domain-containing (RHDC) polypeptides" and their grammatical equivalents as used herein can refer to polypeptides with shared structural and/or functional features. An RHDC can also be referred to as an RNase-H like domain containing protein. In certain embodiments, an RHDC polypeptide has structural features similar to the structure of RNase-H, for example a secondary structure of β-strands and α-helices as follows: $\beta1$-$\beta2$-$\beta3$-$\alpha1$-$\beta4$-$\alpha2$-$\beta5$-$(\alpha3)$-$\alpha4$, wherein $\alpha3$ is optional. In some embodiments, an RHDC polypeptide has nucleic acid-cleaving activity at, for example, about 19° C. to 40° C., as evidenced by the fact that RHDC polypeptides can be derived from a mesophilic organism. In some embodiments, an RHDC polypeptide has nucleic acid-cleaving activity at, for example, about 19° C. to 40° C. In some embodiments, "derived from a mesophilic organism" can refer to a feature that occurs in a mesophilic organism. In some cases, a feature that can be derived from mesophilic organism can share a domain organization of $\beta1$-$\beta2$-$\beta3$-$\alpha1$-$\beta4$-$\alpha2$-$\beta5$-$(\alpha3)$-$\alpha4$, wherein $\alpha3$ is optional, while also have at least 50%, at least 55%, at least 60%, at least 65%, at least 70%, at least 75%, at least 80%, at least 90%, at least 95%, at least 96%, at least 97%, at least 98%, at least 99%, or 100% sequence identity to an RHDC polypeptide that occurs in a mesophilic organism. In some embodiments, an RHDC polypeptide has nucleic acid-cleaving activity or assists in nucleic acid-cleaving activity.

The term "transgene" and its grammatical equivalents as used herein can refer to a gene or genetic material that is transferred into an organism. For example, a transgene can be a stretch or segment of DNA containing a gene that is introduced into an organism. When a transgene is transferred into an organism, the organism is then referred to as a transgenic organism. A transgene can retain its ability to produce RNA or polypeptides (e.g., proteins) in a transgenic organism. A transgene can be composed of different nucleic acids, for example RNA or DNA. A transgene can encode for an engineered T cell receptor, for example a TCR transgene. A transgene can be a TCR sequence. A transgene can be a receptor. A transgene can comprise recombination arms. A transgene can comprise engineered sites.

A "therapeutic effect" can occur if there is a change in the condition being treated. The change can be positive or negative. For example, a 'positive effect' can correspond to an increase in the number of activated T-cells in a subject. In another example, a 'negative effect' can correspond to a decrease in the amount or size of a tumor in a subject. There is a "change" in the condition being treated if there is at least 10% improvement, preferably at least 25%, more preferably at least 50%, even more preferably at least 75%, and most preferably 100%. The change can be based on improvements in the severity of the treated condition in an individual, or on a difference in the frequency of improved conditions in populations of individuals with and without treatment with the therapeutic compositions with which the compositions of the present invention are administered in combination. Similarly, a method of the present disclosure can comprise administering to a subject an amount of cells that is "therapeutically effective". The term "therapeutically effective" should be understood to have a definition corresponding to 'having a therapeutic effect'.

The term "sequence" and its grammatical equivalents as used herein can refer to a nucleotide sequence, which can be DNA or RNA; can be linear, circular or branched; and can be either single-stranded or double stranded. A sequence can be mutated. A sequence can be of any length, for example, between 2 and 1,000,000 or more nucleotides in length (or any integer value there between or there above), e.g., between about 100 and about 10,000 nucleotides or between about 200 and about 500 nucleotides.

Overview

The present disclosure provides methods, systems, compositions and kits for modifying a target nucleic acid using a system comprising an RHDC polypeptide and a nucleic acid unwinding agent. The systems described herein can comprise, for example, a nuclease, a helicase, and an ATPase. These systems overcome technical challenges associated with RHDC proteins including, for example, a lack of activity at temperatures that are conducive for gene editing in human cells. The methods, systems, compositions and kits described herein allow for this physiologically-relevant gene editing by providing an RHDC polypeptide in combination with a nucleic acid unwinding agent. Without wishing to be bound by theory, this combination overcomes the energetic barrier that RHDC proteins face that prevents RHDC proteins alone from inducing single- or double-stranded nucleic acid breaks because the nucleic acid unwinding agent exposes a nucleic acid sequence such that the RHDC polypeptide can cleave in the exposed region. In some embodiments, the RHDC is an Argonaute protein, for example, from a mesophilic organism. In some embodiments, the nucleic acid unwinding agent is a helicase or a topoisomerase. In some embodiments, the RHDC polypeptide and the nucleic acid unwinding agent are provided as a fusion protein. In some embodiments, the RHDC polypeptide and the nucleic acid unwinding agent are provided such that they co-localize on a nucleic acid, without being present as a fusion protein. The present disclosure also provides for the bioinformatic co-localization as a proxy for bioenergy efficiency of DNA repair. In some cases, the physiologic repair is energy efficient and the natural state. In some aspects, the pathologic failure of a double strand break is energy inefficient and the diseased state.

Nuclease Systems for Genetic Engineering

Intracellular genomic transplant can be a method of genetically modifying cells and nucleic acids for therapeutic applications. Provided herein can be a gene editing system containing interchangeable parts. For example, one module of a gene editing system can be replaced whilst not affecting the function of the other modules. The modular gene editing system provided herein can be tunable to allow for dialing-up and dialing-down of a gene editing efficiency and/or the skewing to a particular genomic break repair method. Provided herein are also compositions, constructs, systems, and methods for disrupting a genomic sequence in a subject (e.g. mammal, non-mammal, or plant). Also provided herein are compositions, constructs, systems, and methods of treating or inhibiting a condition caused by a defect in a target sequence in a genomic locus of interest in a subject (e.g., mammal or human) or a non-human subject (e.g., mammal) in need thereof. In some cases, a method can comprise modifying a subject or a non-human subject by manipulation of a target sequence and wherein a condition can be susceptible to treatment or inhibition by manipulation of a target sequence.

Disclosed herein is also a method of genomically editing a system utilizing an RNase-H like domain containing protein that performs a genomic alternation with favorable thermodynamics. A genomic alteration can be exothermic. A genomic alteration can be endothermic. In some cases, A genomic alteration utilizing the disclosed system can be energetically favorable over alternate gene editing systems. An RNase-H-like domain-containing protein system can more thermodynamically favorable as measured by a biochemical system, for example by providing a finite amount of ATP into the reaction and measuring an amount of gene editing before, during, and after the genomic alteration has occurred. In some cases, the disclosed editing system utilizing an RNase-H-like domain-containing protein can reduce an energetic requirement by about 1%, 2%, 3%, 4%, 5%, 6%, 7%, 8%, 9%, 10%, 15%, 20%, 25%, 40%, 50%, or up to about 60% as compared to a system that does not employ an RNase-H-like domain-containing protein. In some cases, the disclosed editing system utilizing an RNase-H-like domain containing protein can reduce an immune response to the RNase-H-like domain containing protein by about 1%, 2%, 3%, 4%, 5%, 6%, 7%, 8%, 9%, 10%, 15%, 20%, 25%, 40%, 50%, or up to about 60% as compared to a system that does not employ the disclosed RNase-H-like domain containing protein. In some cases, an RNase-H-like domain containing protein can be harvested from bacteria that are endogenously present in the human body to prevent eliciting an immune response.

In some cases, a genome that can be disrupted or modified can be from an organism or subject that can be a eukaryote (including mammals including human) or a non-human eukaryote or a non-human animal or a non-human mammal. In some cases, an organism or subject can be a non-human animal, and may be an arthropod, for example, an insect, or may be a nematode. In some cases, an organism or subject can be a plant. In some cases, an organism or subject can be a mammal or a non-human mammal A non-human mammal may be for example a rodent (preferably a mouse or a rat), an ungulate, or a primate. In some methods of the invention the organism or subject is algae, including microalgae, or is a fungus. In some cases, a subject can be a human A human subject can be an adult or a pediatric subject. A pediatric subject can be under the age of 18. An adult subject can be about 18 or over 18 years of age.

A protein with nucleic acid-cleaving activity (e.g., a nuclease) can be an enzyme that cleaves a chain of nucleotides in a nucleic acid into smaller units. A protein with nucleic acid-cleaving activity can be from a eukaryote or a prokaryote. A protein with nucleic acid-cleaving activity can be from a eukaryote. A protein with nucleic acid-cleaving activity can be from a prokaryote. In some cases, a protein with nucleic acid-cleaving activity can be from archaea.

In some cases, a protein with nucleic acid-cleaving activity can be an RNase-H like domain containing protein. In some cases, a nuclease can be a protein that has a secondary structure similar to an RNase-H or an RNase-H-like domain-containing protein. RNase-H can belong to a nucleotidyl-transferase superfamily, which can include transposase, retroviral integrase, Holliday junction resolvase, and RISC nuclease Argonaute. In some cases, an RNase-H or RNase-H-like domain-containing protein can utilize two-metal-ion catalysis as a general feature. In nucleases, two metal ions can be asymmetrically coordinated and have distinct roles in activating a nucleophile and stabilizing a transition state. In some cases, an RNase-H or RNase-H like domain-containing protein can have an α/β fold containing a carboxylate triad in a catalytic center. In some cases, two spatially conserved Asps can be present in a nuclease. For example, an Asp residue may be conserved in a majority of Argonaute sequences. An Asp residue may align spatially with a catalytic Asp residue of RNase-H-like catalytic sites. In some cases, a nuclease can be an RNase-H, reverse transcriptase, integrase, Tn5, Argonaute, RuvC, Cas, or a combination thereof. In some cases, a nuclease can be an enzyme that may share an RNase-H domain with any one of RNase-H, reverse transcriptase, integrase, Tn5, Argonaute, RuvC, or Cas. In other cases, a nuclease can be substantially similar in structure to any one of RNase-H, reverse transcriptase, integrase, Tn5, Argonaute, RuvC, or Cas. A substantially similar structure may contain a β-fold containing a central five-stranded mixed β-sheet surrounded by α-helices on both sides. In some cases, an RNase-H structure can also have additional helices and loops inserted between two α-turn-β units, which can form part of a substrate-binding surface. In some cases, a substantially similar structure contains an active site. An active site of an RNase-H or RNase-H like protein can contain a set of three highly conserved carboxylates. In some cases a domain may be RuvC. In some cases, a domain is a PIWI domain. In some cases, a phylogenetic tree identifies possible PIWI domains in organisms that can be used to identify suitable nuclease or helicase domains, FIG. 1.

In some cases, an enzymatic polypeptide can be an RNA-dependent DNase editor, an RNA-dependent RNase editor, a DNA-dependent DNase editor, or a DNA-dependent RNase editor. Examples of an RNA-dependent DNase editor can be Cas9 and Cpf1 to name a couple. An example of an RNA-dependent RNase editor is Cas13. An enzymatic protein can contain multiple domains. For example, an enzymatic polypeptide can contain domains that can bind to a duplex of DNA-RNA, DNA-DNA, or RNA-RNA. For example, RuvC can bind Cas9 and Cpf1; HNH can bind Cas9, RNase-H can bind ribonuclease, and PIWI can bind Ago.

In some cases, an RHDC polypeptide can be expressed by a gene located adjacent to an operon of at least one of P-element induced WImpy testis (PIWI) gene, RuvC, Cas, Sir2, Mrr, TIR, PLD, REase, restriction endonuclease, DExD/H, superfamily II helicase, RRXRR (SEQ ID NO: 380), DUF460, DUF3010, DUF429, DUF1092, COG5558, OrfB_IS605, Peptidase A17, Ribonuclease H-like domain, 3'-5' exonuclease domain, 3'-5' exoribonuclease Rv2179c-like domain, Bacteriophage Mu, transposase, DNA-directed DNA polymerase, family B, exonuclease domain, Exonuclease, RNase T/DNA polymerase III, yqgF gene, HEPN, RNase LS domain, LsoA catalytic domain, KEN domain, RNaseL, Ire 1, RNase domain, RloC, PrrC, or modified versions thereof. An RHDC polypeptide disclosed herein can be interchangeable. For example, an RHDC polypeptide domain can be any nuclease domain that can be selected from a list comprising: CRISPR, Argonaute, meganuclease, Zinc finger nuclease (ZFN), TALEN, or a restriction enzyme. In some cases, when a RHDC domain is interchanged, the interchanging may not affect a function of the remaining modules of the gene editing system (a nucleic acid unwinding agent or an RDP). In some cases, a gene editing system can be dialed-up or dialed-down. A dialing up can be performed by interchanging a domain such as RHDC polypeptide for a stronger performing RHDC polypeptide. A dialing up can enhance a double strand break repair by about 5%, 10%, 15%, 20%, 30%, 40%, 50%, 60%, 70%, 80%, 90%, 95%, or up to about 100% as compared to a comparable gene editing system. A dialing down can be performed by interchanging a domain such as RHDC polypeptide for a weaker performing RHDC polypeptide for improved homology directed repair (HDR) of a double strand break. In some cases, interchanging a module of a gene editing system can allow for HDR of a double strand break. Use of a gene editing system disclosed herein can allow for preferential HDR of a double strand break over that of comparable or alternate gene editing systems. In some cases, an HDR repair can preferentially occur in a population of cells at %, 10%, 15%, 20%, 30%, 40%, 50%, 60%, 70%, 80%, 90%, 95%, or up to about 100% over that which occurs in a comparable gene editing system.

In some cases, an RHDC or a functional fragment thereof can be selected from a phylum of bacteria selected from: Chloroflexi, Proteobacteria, Bacteroidetes, Planctomycetes, Firmicutes, Cyanobacteria, Bacteroidetes, Balneolaeota, Bacteroidetes, Euryarchaeota, Crenarchaeota, Firmicutes, Euryarchaeota, Actinobacteria, Thermotogae, Deinococcus, Spirochaetes, Acidobacteria, modified versions thereof, or any combination thereof.

In some cases, an RHDC or a functional fragment thereof can be selected from a class of bacteria selected from: phylum Chloroflexi (Class:Thermoflexi, dehalococcoidia, anaerolinaea, ardenticatenia, caldilineae, ktedonobacteria, thermomicrobia, chloroflexia), phylum Proteobacteria (class: Alphaproteobacteria, Betaproteobacteria, hydrogenophilalia, Gammaproteobacteria, acidithiobacillia, Deltaproteobacteria, epsilonproteobacteria, oligoflexia), phylum Bacteroidetes (class: rhodothermia, balneolia, cytophagia, sphingobacteria, chitinophagia, bacteroidia, flavobacteriia), phylum Planctomycetes (class: phycisphaerae, plantomycetacia), phylum Firmicutes (class: bacillales, clostridia, thermolithobacteria), phylum Cyanobacteria (class: chroococcales, chroococcidiopsidales, gleobacterales, nostocales, oscillatoriales, pleurocapsales, spirulinales, synechococcales, incertae sedis), phylum Bacteroidetes (class: rhodothermia, balneolia, cytophagia, sphingobacteria, chitinophagia, bacteroidia, flavobacteriia), phylum Balneolaeota (class:balneolia), phylum Euryarchaeota (class: aciduliprofundum, archaeoglobi, halobacteria, methanobacteria, methanococci, methanomicrobia, methanopyri, nanohaloarchaea, thermococci, thermoplasmata), phylum Crenarchaeota (class: eocyta, eocytes, crenarchaeot garrity and holt), phylum Actinobacteria (class: rubrobacteria, thermoleophilia, coriobacteriia, acidimicrobiia, nitrilliruptoia, Actinobacteria), phylum Thermotogae (class: Thermotogae), Deinococcus (class: deinococci), phylum Spirochaetes (class:spirochaetia), phylum Acidobacteria (class: Acidobacteria, blastocatellia, holophagae), modified versions thereof, or any combination thereof. In some cases, an RHDC or a functional fragment thereof can be selected from a species selected from: *Dehalococcoides mccartyi* DCMB5, *Cupriavidus metallidurans* H1130, *Acinetobacter venetianus*, *Methylobacter whittenburyi*, *Bacteroides fragilis* str. 11345, *Candidatus* Brocadia sinica JPN1, *Clostridium sartagoforme* AAU1, *Calothrix* sp. PCC 7103, *Microcystis aeruginosa* PCC 9701, *Elizabethkingia meningoseptica*, *Rhodohalobacter halophilus*, *Parabacteroides goldsteinii* CLO2T12C30, *Sphingobium chlorophenolicum* L-1, *Methanotorris formicicus* Mc-S-70, *Hymenobacter psychrotolerans* DSM 18569, *Vulcanisaeta moutnovskia* 768-28, *Flavobacterium seoulense*, *Elizabethkingia anophelis*, *Rhodopseudomonas palustris* DX-1, *Lachnospiraceae bacterium* VE202-12, *Thermococcus barophilus*, *Rhizobium undicola* ORS 992=ATCC 700741, *Anoxybacillus gonensis*,

*Bacteroides thetaiotaomicron, Flavobacterium johnsoniae, Microcystis aeruginosa* KW, *Burkholderia* sp. H160, *Chroococcidiopsis thermalis* PCC 7203, *Fischerella major* NIES-592, *Cyclobacterium marinum* DSM 745, *Flavobacterium* sp. Root186, *Nocardia sienata* NBRC 100364, *Thermoactinomyces* sp. CDF, *Methylobacterium mesophilicum* SR1.6/6, *Nonlabens ulvanivorans, Synechococcus* sp. PCC 7003, *Psychroserpens damuponensis, Flavobacterium soli* DSM 19725, *Acinetobacter nosocomialis, Methanocaldococcus fervens* AG86, *Dehalococcoides mccartyi* CBDB1, *Marinitoga hydrogenitolerans* DSM 16785, *Thermus brockianus, Thermus scotoductus* SA-01, *Rhodopirellula maiorica* SM1, *Hydrogenophaga* sp. PBC, *Deinococcus* sp. YIM 77859, *Kurthia massiliensis, Thermococcus onnurineus* NA1, *Prevotella intermedia* ZT, *Hyphomonas* sp. T16B2, *Halopiger djelfimassiliensis, Porphyromonas gingivalis, Natrialba asiatica* DSM 12278, *Microcystis* sp. T1-4, *Pseudomonas aeruginosa, Sediminibacterium* sp. C3, *Fluviicola taffensis* DSM 16823, *Haloferax* sp. BAB2207, *Cecembia lonarensis* LW9, *Leptolinea tardivitalis, Thermosynechococcus elongatus* BP-1, *Mesorhizobium* sp. L2C066B000, *Cellulophaga lytica* DSM 7489, *Halorubrum kocurii* JCM 14978, *Paenibacillus borealis, Chryseobacterium* sp. JM1, *Variovorax paradoxus* B4, *Methylibium* sp. YR605, *Porphyromonadaceae bacterium* COT-184 OH4590, *Hyphomonas* sp. T16B2, *Leptospira noguchii, Clostridiales bacterium* NK3B98, *Geobacillus* sp. FW23, [*Clostridium*] *citroniae* WAL-19142, *Clostridium disporicum, Burkholderia vietnamiensis, Bacteroides fragilis* str. 3397 T14, *Leptolyngbya* sp. '*hensonii*', *Acidobacterium capsulatum* ATCC 51196, *Clostridium perfringens* WAL-14572, *Geobacillus kaustophilus* GBlys, *Clostridium saudiense, Methylomicrobium buryatense* 5G, *Enterobacter kobei, Deinococcus* sp. RL In some cases, an RHDC or a functional fragment thereof can be selected from at least one of *Vulcanisaeta moutnovskia, Thermoproteus uzoniensis, Pyrobaculum, Modestobacter marinus, Acidovorax avenae, Pseudomonas synxantha, Xanthomonas campestris, Caulobacter segnis, Pseudomonas putida, Xanthomonas vesicatoria, Pseudomonas stutzeri, Pantoea, Cupriavidus, Geobacter sulfurreducens, Chlorobium phaeobacteroides, Bordetella bronchiseptica, Woodsholea maritima, Novosphingobium pentaromativorans, Rhizobium phaseoli, Polymorphum gilvum, Bradyrhizobium elkanii, Bradyrhizobium, Bradyrhizobium oligotrophicum, Geobacter uraniireducens, Planctomyces limnophilus, Parvularcula bermudensis*, alpha proteobacterium, *Acinetobacter, Acinetobacter ursingii, Acinetobacter bereziniae, Mariprofundus ferrooxydans, Burkholderia* sp-H160, *Thioalkalivibrio thiocyanoxidans, Variovorax paradoxus, Burkholderia graminis, Burkholderia xenovorans* LB400, *Bacteroides fragilis* 638R, *Desulfobacula toluolica* To12, *Clostridium termitidis, Clostridium* sp-CAG-264, *Clostridium bolteae, Firmicutes bacterium* CAG-65, *Bacteroides, Bacteroidesovatus, Fluviicola taffensis* DSM 16823, *Joostella marina, Bacteroides massiliensis, Parabacteroides goldsteinii, Empedobacter brevis, Bacteroides eggerthii, Bacteroides fluxus. Alistipes putredinis, Parabacteroides merdae, Treponema vincentii, Lachnospiraceae bacterium* 3 1 57FAA CT1, *Brachyspira* sp-CAG-484, *Clostridiales bacterium* NK3B98, *Firmicutes bacterium* CAG-137, *Desulfovibrio* sp-6 1 46AFAA, *Stenotrophomonas maltophilia* R551-3, *Owenweeksia hongkongensis* DSM, *Cyclobacterium marinum* DSM 745, *Bacteroides coprophilus, Bacteroides intestinalis* CAG-564, *Pedobacter saltans* DSM 12145, *Hyphomicrobium denitrificans* 1NES1, *Sphingomonas* sp-S17, *Rhodopseudomonas palustris* BisB5, *Agrobacterium* sp-H13-3, *Elioraea tepidiphila, Rhodanobacter denitrificans, Rhizobium etli* CIAT 652, *Pelagibacterium halotolerans* B2, *Tistrella mobilis* KA081020-065, *Sphingomonas wittichii* RW1, *Acidobacterium capsulatum* ATCC 51196, *Gluconacetobacter diazotrophicus* PAl 5, *Mesorhizobium* sp-STM 4661, *Sinorhizobium fredii* NGR234, *Sinorhizobium medicae* WSM419, *Mesorhizobium metallidurans, Methanosarcina acetivorans* C2A, halophilic archaeon DL31, *Haloarcula marismortui* ATCC 43049, *Halorubrum lacusprofundi* ATCC 49239, *Halosarcina pallida, Halorubrum tebenquichense, Rhizobium lupine, Granulicella tundricola* MPSACTX9, *Methylomicrobium album, Novosphingobium* sp-PP1Y, *Rhodopirellula maiorica, Flavobacterium indicum* GPTSA100-9, *Planctomyces maris, Leptolyngbya* sp-PCC 7375, *Bacteroides thetaiotaomicron, Bacteroides* sp-3 1 19, *Parabacteroides, Sphingobacterium spiritivorum, Fibrella aestuarina* BUZ 2, *Anaerophaga thermohalophila, Vibrio tubiashii, Gilvimarinus chinensis, Shewanella* sp-ANA-3, *Providencia rettgeri, Alishewanella agri, Pseudomonas plecoglossicida, Pseudomonas alcaligenes, Pseudomonas aeruginosa, Novosphingobium pentaromativorans, Methylobacterium mesophilicum, Azospirillum amazonense, Methylibium petroleiphilum* PM1, *Methylohalobius crimeensis, Parvularcula bermudensis* HTCC2503, *Opitutaceae bacterium* TAV5, *Pedosphaera parvula, Acidobacteriaceae bacterium* TAA166, *Cupriavidus metallidurans* CH34, *Cupriavidus taiwanensis, Mycobacterium* sp-KMS, *Modestobacter marinus, Rhizobium phaseoli, Sphingomonas* sp-KCB, *Bradyrhizobium* sp-YR681, *Methylobacterium* sp-88A, *Novosphingobium pentaromativorans, Maritimibacter alkaliphilus, Sphingobium yanoikuyae, Beijerinckia indica* subsp-indica ATCC 9039, *Brucella inopinata, Mesorhizobium loti* MAFF303099, *Afipia broomeae, Asticcacaulis biprosthecium, Sphingopyxis baekryungensis, Fodinicurvata sediminis, Sulfitobacter* sp-NAS-14-1, *Rhodovulum* sp-PH10, *Xanthobacter autotrophicus* Py2, *Sulfolobus islandicus* M-16-27, *Caldanaerobacter subterraneus, Cytophaga hutchinsonii* ATCC 33406, *Solitalea canadensis* DSM 3403, *Bacteroides* sp-CAG-189, *Winogradskyella psychrotolerans, Cecembia lonarensis, Flavobacterium* sp-WG21, *Sphingobium chlorophenolicum* L-1, *Streptomyces coelicolor* A3-2, *Methylobacterium mesophilicum, Parvularcula bermudensis* HTCC2503, *Rhodopseudomonas palustris* DX-1, *Pelotomaculum thermopropionicum* SI, *Syntrophobacter fumaroxidans* MPOB, *Acinetobacter baumannii, Acinetobacter nosocomialis, Hydrogenophaga* sp-PBC, *Salmonella enterica, Gemmata obscuriglobus, Zavarzinella Formosa, Acidovorax ebreus* TPSY, *Rhodopirellula maiorica, Cyanothece* sp-PCC 8801, *Rhodobacter sphaeroides* ATCC 17025, *Acidobacterium capsulatum* ATCC 51196, *Archaeoglobus fulgidus* DSM 4304, *Calditerrivibrio nitroreducens* DSM 19672, *Marinimicrobia bacterium* JGI 0000039-D08, *Cellulophaga lytica* DSM 7489, *Belliella baltica* DSM 15883, *Cyclobacterium marinum* DSM 745, *Acinetobacter baumanniil. Acinetobacter nosocomialis, Treponema* medium, *Pirellula staleyi* DSM 6068, *Leptospira interrogans, Pedobacter heparinus* DSM 2366, *Spirosoma linguale* DSM 74, *Leptospira santarosai, Anoxybacillus* sp-DT3-1, *Methylovulum miyakonense, Sulfolobus tokodaii* str-7, *Candidatus Nitrososphaera gargensis* Ga9-2, *Scytonema hofmanni, Cyanothece* sp-PCC 8802, *Calothrix* sp-PCC 7103, *Oryza sativa Japonica* Group, *Natronobacterium gregoryi* SP2, *Halobacterium* sp-DL1, *Prochlorothrix hollandica, Halopiger xanaduensis* SH-6, *Haloferax elongans, Haloferax denitrificans, Natronorubrum tibetense, Natrinema pellirubrum* DSM 15624, *Pseudoalteromonas luteoviolacea, Aromatoleum aromaticum* EbN1, *Syn-* echococcus sp-PCC 7002, *Synechococcus elongatus* PCC 7942, *Synechococcus* sp-JA-3-3Ab, *Cyanothece* sp-PCC 7822, *Stanieria cyanosphaera* PCC 7437, *Thermus scotoductus* SA-01, *Thermus* sp-CCB US3 UF1, *Halorubrum lacusprofundi* ATCC 49239, *Ignisphaera aggregans* DSM 17230, *Aquifex aeolicus* VFS, *Chamaesiphon minutus* PCC 6605, *Oscillatoria acuminata* PCC 6304, *Lyngbya* sp-PCC 8106, *Chroococcidiopsis thermalis* PCC 7203, *Rivularia* sp-PCC 7116, *Microcystis aeruginosa* NIES-843, *Crinalium epipsammum* PCC 9333, *Anabaena cylindrical* PCC 7122, *Fischerella* sp-JSC-11, *Calothrix* sp-PCC 7507, *Burkholderia ambifaria*, and/or *Thioalkalivibrio thiocyanoxidans*.

In some cases, a polypeptide construct can comprise a *Clostridium disporicum* Argonaute domain, or a functional fragment or variant thereof. In some cases, a polypeptide construct can comprise an RHDC polypeptide that comprises a *Thermoactinomyces* Argonaute domain, or a functional fragment or variant thereof, that can demonstrate nucleic acid-cleaving activity at 37° C. In some cases, a polypeptide construct comprises a domain from *Thermoactinomyces* sp CDF Argonaute domain, or a functional fragment or variant thereof. In some cases, a polypeptide construct can comprise an RHDC polypeptide that comprises a *Methylobacter* Argonaute domain, or a functional fragment or variant thereof, that cleaves a nucleic acid at 37° C. In some cases, a polypeptide construct comprises a *Methylobacter* Argonaute domain that comprises a *Methylobacter whittenburyi* Argonaute domain, or a functional fragment or variant thereof. In some cases, a polypeptide construct comprises an RHDC polypeptide that comprises a *Thermosynechococcus* Argonaute domain, or a functional fragment or variant thereof, that cleaves a nucleic acid at 37° C. In some cases, a polypeptide construct comprises an *Thermoactinomyces* Argonaute domain that comprises a *Thermosynechococcus elongates* Argonaute domain, or a functional fragment or variant thereof.

In some cases, a nucleic acid construct as described herein can encode a prokaryotic RNase H-like domain-containing (RHDC) polypeptide and a nucleic acid unwinding polypeptide. In some cases, an RHDC polypeptide cleaves a nucleic acid at a mesophilic temperature. Nucleic acid-cleaving activity can be directed by a guide DNA. In some cases, an RHDC polypeptide can be fused to a nucleic acid unwinding polypeptide. In some cases, a nucleic acid construct as described herein can encode an RNase H-like domain-containing (RHDC) polypeptide and a nucleic acid unwinding polypeptide. In some cases, a protein encoded by an RHDC polypeptide cleaves a nucleic acid at a mesophilic temperature. In some cases, nucleic acid-cleaving activity can be directed by a guide DNA. In some cases, an RHDC polypeptide can be fused to a nucleic acid unwinding polypeptide. In some cases, a protein encoded by a polypeptide construct further demonstrates nucleic acid-insertion activity. In some cases, an insertion can be of an exogenous transgene. An exogenous transgene can be a cellular receptor in some cases, such as a chimeric antigen receptor or a T cell receptor.

Figure 3:
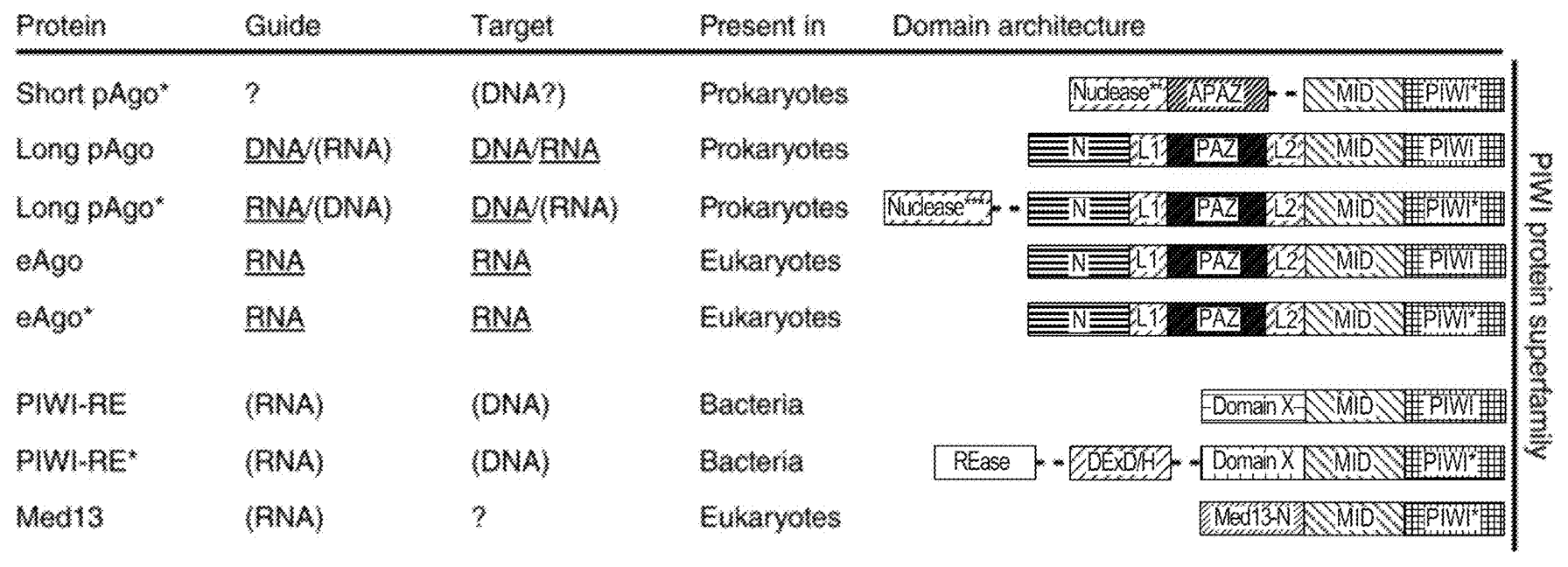
Figure 5:
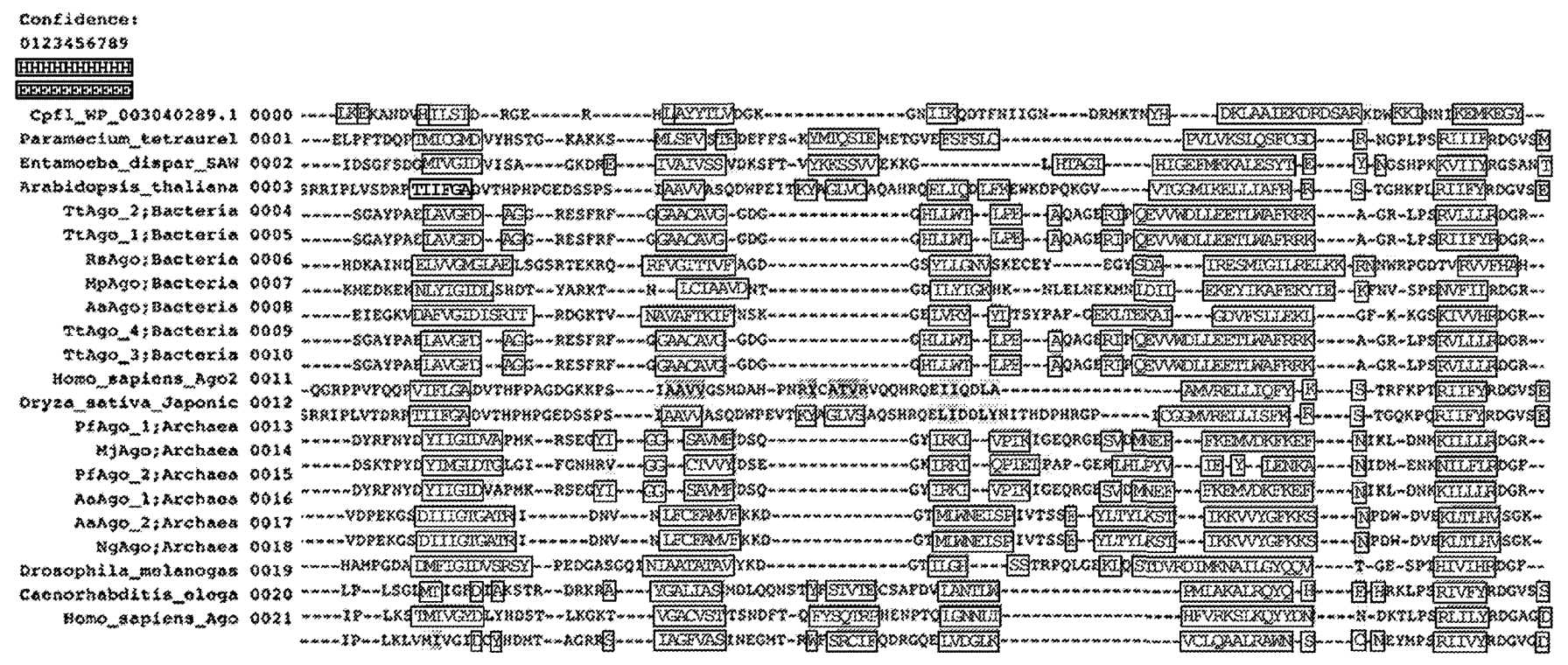

In some cases, an RHDC polypeptide can be chosen based on proximity to a secondary gene in a genome. For example, an RHDC polypeptide may be chosen based on its location adjacent to a helicase gene such ssDNA helicase SF1. In some cases, an RHDC polypeptide can be chosen based on proximity to DNA repair associated genes. In some cases, an RHDC polypeptide can be chosen based on a predicted alignment (e.g., structural analysis) or phylogenetic analysis, FIGS. 4-8D. For example, an RHDC polypeptide may have homology or be conserved in relation to a gene sequence of a secondary gene. In some cases, an RHDC polypeptide can be highly conserved in relation to RNase-H. Conservation can refer to a sequence or structure. Structural conservation can refer to the presence or absence of structural features. A structural feature can be a secondary structural feature such as an alpha helix or beta pleated sheet, FIG. 5. An RHDC polypeptide can be screened or chosen based on a secondary structure. An RHDC polypeptide can be RNase-HI, RNase-HIII, RVE/Trasp, Argonaute, Prp8, RuvC, RuvX, RNase T, or DNA PolIII. An RHDC polypeptide can share a secondary structure similar to at least one of RNase-HI, RNase-HIII, RVE/Trasp, Argonaute, Prp8, RuvC, RuvX, RNase T, or DNA PolIII. In some cases, a nuclease is chosen based on a presence of an RHDC polypeptide fold in a structure. In some cases, an RHDC polypeptide is chosen based on conservation in an N-terminus or C-terminus. For example, a C-terminus may contain a PIWI domain and be conserved among a suitable nuclease, FIG. 3.

In some cases, a nuclease can be identified by the presence or absence of an RNase-H fold. An RNase-H fold can be one of the evolutionarily oldest protein folds that may be shared amongst different nucleases. In some cases, in the course of divergent evolution sequences of nuclease members accumulated numerous substitutions, insertions, deletions and underwent fusions with various domains. Due to this divergence, sequence similarity between different families of RNHL proteins can be low. In some cases, sequence similarity can be undetectable. The length of an RNase-H-like domain in different proteins can vary significantly owing to a presence of numerous insertions in a catalytic core. In some cases, a sequencing analysis can be performed to identify nucleases that share a domain, such as RNase-H or RNase-H-like.

In some cases, an RHDC polypeptide can be fused to at least one additional element, for example a helicase. In some cases, a nuclease can be fused to an ATPase. In some cases, an RHDC polypeptide can be fused to another RHDC polypeptide. In some cases, an RHDC polypeptide can be fused with a targeting polynucleic acid or targeting protein. In some cases, an RHDC polypeptide can be a fusion construct of an RHDC polypeptide and a nucleic acid unwinding polypeptide. In some cases, fusion proteins are comprised of polypeptides derived from a mesophilic organism. A mesophilic organism can be from a family selected from the group consisting of: bacteroidetes, proteobacteria, actinobacteria, firmicutes, cyanobacteria, spirochaetes, deinococcus, verrucomicrobia, planctomycetes, balneolaeota, and chloroflexi. A mesophilic organism can be from a family selected from the group consisting of: proteobacteria, acidobacteria, actinobacteria, and bacteroidetes.

In some cases, an RHDC polypeptide can be a polypeptide that can have nuclease activity. Nuclease activity can be double stranded polynucleic acid cleaving activity, such as DNA or RNA. In some cases, nuclease activity can be single stranded polynucleic acid cleaving activity. In some cases, an RHDC polypeptide can have nickase activity. Nickase activity can be single stranded DNA or RNA cleaving activity. In some cases, an RHDC polypeptide can have RNase activity. In some cases, RNase activity can be double stranded RNA cleaving activity. In some cases, RNase activity can be RNA cleaving activity. In some cases, an RHDC protein or polypeptide can have RNase-H activity. In some cases, RNase-H activity can be RNA cleaving activity. In some cases, an RHDC polypeptide can have recombinase activity. An RHDC polypeptide can also have DNA-flipping activity. In some cases, an RHDC polypeptide can have transposase activity.

Fusion proteins can be synthesized using known technologies, for instance, recombination DNA technology where the coding sequences of various portions of the fusion proteins can be linked together at the nucleic acid level. Subsequently a fusion protein can be produced using a host cell. In some embodiments, a fusion protein comprises a cleavable or non-cleavable linker between the different sections or domains of the protein (e.g, between a nucleic acid unwinding domain and an RHDC polypeptide). For example, a linker can be a polypeptide linker, such as a linker that is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more amino acids long. As described herein, two polypeptide sequences that are "fused" need not be directly adjacent to each other. Fused polypeptide sequences can be fused by a linker, or by an additional functional polypeptide sequence that is fused to the polypeptide sequences.

A linker can be a GSGSGS linker (SEQ ID NO: 381). In some cases, there can be from 1, 2, 3, 4, 5, 6, 7, 8, 9, or up to 10 linkers on a genome editing construct. For example, there can be from 1 to 10 GSGSGS linkers. A linker can comprise non-charged or charged amino acids. A linker can comprise alpha-helical domains A linker can comprise a chemical cross linker. In some cases, a linker can be of different lengths to adjust the function of fused domains and their physical proximity. In some cases, a linker can comprise peptides with ligand-inducible conformational changes.

In some embodiments, a nuclease can be an Argonaute protein or polypeptide or functional domain or variant thereof. Argonaute proteins can be relatively large proteins of about 800 to about 1200 amino acids. An Argonaute protein or polypeptide or functional domain or variant thereof can be of eukaryote origin. An Argonaute protein or polypeptide or functional domain or variant thereof can be of prokaryote origin. A eukaryotic Argonaute protein can include mouse Argonaute proteins, such as AG02. An Argonaute protein may be derived from an archaeal or a bacterial organism. An Argonaute protein may be derived from a mesophilic organism. A mesophilic organism can be an organism that is active at temperatures from about 19° C. to 40° C. In some embodiments, a mesophilic organism can be active from temperatures of about 17° C., about 18° C., 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or up to 40° C. In some embodiments, a mesophilic organism can be active at temperatures from about 17° C. to 40° C. In some embodiments, a mesophilic organism can be active at temperatures of at least about 17° C. In some embodiments, a mesophilic organism can be active at temperatures of at most 40° C. In some embodiments, a mesophilic organism can be active at temperatures of about 17° C. to about 19° C., about 17° C. to about 21° C., about 17° C. to about 23° C., about 17° C. to about 25° C., about 17° C. to about 27° C., about 17° C. to about 29° C., about 17° C. to about 31° C., about 17° C. to about 33° C., about 17° C. to about 35° C., about 17° C. to about 37° C., about 17° C. to 40° C., about 19° C. to about 21° C., about 19° C. to about 23° C., about 19° C. to about 25° C., about 19° C. to about 27° C., about 19° C. to about 29° C., about 19° C. to about 31° C., about 19° C. to about 33° C., about 19° C. to about 35° C., about 19° C. to about 37° C., about 19° C. to about 40° C., about 21° C. to about 23° C., about 21° C. to about 25° C., about 21° C. to about 27° C., about 21° C. to about 29° C., about 21° C. to about 31° C., about 21° C. to about 33° C., about 21° C. to about 35° C., about 21° C. to about 37° C., about 21° C. to 40° C., about 23° C. to about 25° C., about 23° C. to about 27° C., about 23° C. to about 29° C., about 23° C. to about 31° C., about 23° C. to about 33° C., about 23° C. to about 35° C., about 23° C. to about 37° C., about 23° C. to 40° C., about 25° C. to about 27° C., about 25° C. to about 29° C., about 25° C. to about 31° C., about 25° C. to about 33° C., about 25° C. to about 35° C., about 25° C. to about 37° C., about 25° C. to 40° C., about 27° C. to about 29° C., about 27° C. to about 31° C., about 27° C. to about 33° C., about 27° C. to about 35° C., about 27° C. to about 37° C., about 27° C. to about 40° C., about 29° C. to about 31° C., about 29° C. to about 33° C., about 29° C. to about 35° C., about 29° C. to about 37° C., about 29° C. to about 40° C., about 31° C. to about 33° C., about 31° C. to about 35° C., about 31° C. to about 37° C., about 31° C. to about 40° C., about 33° C. to about 35° C., about 33° C. to about 37° C., about 33° C. to about 40° C., about 35° C. to about 37° C., about 35° C. to about 40° C., or about 37° C. to about 40° C. In certain embodiments described herein an Argonaute polypeptide can comprise a functional domain from an Argonaute protein described herein, or variant thereof.

In some cases, an RHDC polypeptide can demonstrate nucleic acid-cleaving activity in a range of temperatures including about 19° C. to about 41° C. In some cases, a nuclease or RHDC polypeptide can be from a mesophilic organism. An RHDC polypeptide can be an Argonaute protein, polypeptide or functional portion thereof. In some embodiments, an RHDC polypeptide has nucleic acid-cleaving activity at temperatures of about 17° C., about 18° C., 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or up to 40° C. In some embodiments, an RHDC polypeptide has nucleic acid-cleaving activity at temperatures from about 17° C. to 40° C. In some embodiments, a mesophilic organism can be active at temperatures of at least about 17° C. In some embodiments, a mesophilic organism can be active at temperatures of at most 40° C. In some embodiments, a mesophilic organism can be active at temperatures from about 17° C. to about 19° C., about 17° C. to about 21° C., about 17° C. to about 23° C., about 17° C. to about 25° C., about 17° C. to about 27° C., about 17° C. to about 29° C., about 17° C. to about 31° C., about 17° C. to about 33° C., about 17° C. to about 35° C., about 17° C. to about 37° C., about 17° C. to 40° C., about 19° C. to about 21° C., about 19° C. to about 23° C., about 19° C. to about 25° C., about 19° C. to about 27° C., about 19° C. to about 29° C., about 19° C. to about 31° C., about 19° C. to about 33° C., about 19° C. to about 35° C., about 19° C. to about 37° C., about 19° C. to 40° C., about 21° C. to about 23° C., about 21° C. to about 25° C., about 21° C. to about 27° C., about 21° C. to about 29° C., about 21° C. to about 31° C., about 21° C. to about 33° C., about 21° C. to about 35° C., about 21° C. to about 37° C., about 21° C. to 40° C., about 23° C. to about 25° C., about 23° C. to about 27° C., about 23° C. to about 29° C., about 23° C. to about 31° C., about 23° C. to about 33° C., about 23° C. to about 35° C., about 23° C. to about 37° C., about 23° C. to 40° C., about 25° C. to about 27° C., about 25° C. to about 29° C., about 25° C. to about 31° C., about 25° C. to about 33° C., about 25° C. to about 35° C., about 25° C. to about 37° C., about 25° C. to 40° C., about 27° C. to about 29° C., about 27° C. to about 31° C., about 27° C. to about 33° C., about 27° C. to about 35° C., about 27° C. to about 37° C., about 27° C. to 40° C., about 29° C. to about 31° C., about 29° C. to about 33° C., about 29° C. to about 35° C., about 29° C. to about 37° C., about 29° C. to 40° C., about 31° C. to about 33° C., about 31° C. to about 35° C., about 31° C. to about 37° C., about 31° C. to 40° C., about 33° C. to about 35° C., about 33° C. to about 37° C., about 33° C. to 40° C., about 35° C. to about 37° C., about 35° C. to 40° C., or about 37° C. to 40° C.

An Argonaute polypeptide can be from *Homo sapiens, Arabidopsis thaliana, Oryza sativa japonica, Entamoeba dispar, Paramecium tetraurelia, Drosophila melanogaster, Caenorhabditis elegans*. An Argonaute polypeptide can be *Homo sapiens* Ago2, *Arabidopsis thaliana* Ago, *Oryza sativa japonica* Ago, *Entamoeba dispar* SAW760 Ago, *Paramecium tetraureliastrain* d4-2 Ago, *Drosophila melanogaster* Ago, *Caenorhabditis elegans* Ago, or *Homo sapiens* Ago. In some cases, an RHDC polypeptide can comprise an Argonaute protein or functional domain.

In some cases, an Argonaute polypeptide or portion thereof can be a naturally-occurring Argonaute polypeptide (e.g., naturally occurs in bacterial and/or archaeal cells). In other cases, an Argonaute polypeptide may not be a naturally-occurring polypeptide (e.g., an Argonaute polypeptide can be a variant, chimeric, or fusion). In some cases, an Argonaute polypeptide can have nuclease activity. In some cases, an Argonaute polypeptide may not have nuclease activity.

In some cases, an Argonaute polypeptide can be a type I prokaryotic Argonaute. In some cases, a type I prokaryotic Argonaute can carry a DNA nucleic acid-targeting nucleic acid. In some cases, a DNA nucleic acid-targeting nucleic acid targets one strand of a double stranded DNA (dsDNA) to produce a nick or a break of the dsDNA. A nick or break can trigger host DNA repair. In some cases, a host DNA repair can be nonhomologous end joining (NHEJ) or homologous directed recombination (HDR). In some cases, a dsDNA can be selected from a genome, a chromosome, and a plasmid. A type I prokaryotic Argonaute can be a long type I prokaryotic Argonaute, which may possess an N-PAZ-MID-PIWI domain architecture. In some cases a long type I prokaryotic Argonaute possesses a catalytically active PIWI domain. The long type I prokaryotic Argonaute can possess a catalytic tetrad encoded by aspartate-glutamate-aspartate-aspartate/histidine (DEDX). The catalytic tetrad can bind one or more magnesium ions or manganese ions. In some cases, the type I prokaryotic Argonaute anchors the 5' phosphate end of a DNA guide. In some cases, a DNA guide can have a deoxy-cytosine at its 5' end.

In some embodiments, a prokaryotic Argonaute is a type II Ago. A type II prokaryotic Argonaute can carry an RNA nucleic acid-targeting nucleic acid. An RNA nucleic acid-targeting nucleic acid can target one strand of a double stranded DNA (dsDNA) to produce a nick or a break of the dsDNA which may trigger host DNA repair; the host DNA repair can be non-homologous end joining (NHEJ) or homologous directed recombination (HDR). In some cases, a dsDNA can be selected from a genome, a chromosome and a plasmid. A type II prokaryotic Argonaute may be a long type II prokaryotic Argonaute or a short type II prokaryotic Argonaute. A long type II prokaryotic Argonaute may have an N-PAZ-MID-PIWI domain architecture. A short type II prokaryotic Argonaute may have a MID and PrWI domain, but may not have a PAZ domain. In some cases, a short type II Ago can have an analog of a PAZ domain. In some cases a type II Ago may not have a catalytically active PIWI domain. A type II Ago may lack a catalytic tetrad encoded by aspartate-glutamate-aspartate-aspartate/histidine (DEDX). In some cases, a gene encoding a type II prokaryotic Argonaute clusters with one or more genes encoding a nuclease, a helicase or a combination thereof. A nuclease may be natural, designed or a domain thereof. In some cases, the nuclease is selected from a Sir2, RE1 and TIR. The type II Ago may anchor the 5' phosphate end of an RNA guide. In some cases, the RNA guide has a uracil at its 5' end. In some cases, the type II prokaryotic Argonaute is a *Rhodobacter sphaeroides* Argonaute. In some cases, it may be desirable to use an Argonaute nuclease that has lost its ability to cleave a nucleic acid, such as in applications where the Argonaute: guide molecule complex is used as a probe. In some cases, a dead Argonaute system may utilize secondary nucleases to perform a genomic disruption. In such cases, one or more of the amino acid residues in a catalytic domain can be substituted or deleted, such that catalytic activity can be abolished, or diminished. In other cases, using a cleavage temperature-inducible Argonaute may be desired to control the timing of cleavage, or if cleavage should be inhibited at non-inducible temperatures.

In some cases, an Argonaute polypeptide can have at least one active domain. For example, an Argonaute's active domain can be a PIWI domain. In addition to a catalytic PIWI domain an Argonaute can contain non-catalytic domains such as PAZ (PIWI-Argonaute-Zwille), MID (Middle) and N domain, along with two domain linkers, L1 and L2. A MID domain can be utilized for binding the 5'-end of a guiding polynucleic acid and can be present in an Ago protein. A PAZ domain can contain an OB-fold core. An OB-fold core can be involved in stabilizing a guiding polynucleic acid from a 3'end. An N domain may contribute to a dissociation of the second, passenger strand of a loaded double stranded genome and to a target cleavage. In some cases, an Argonaute family may contain PIWI and MID domains. In some cases, an Argonaute family may or may not contain PAZ and N domains.

In some cases, an Argonaute polypeptide can be or can comprise a naturally-occurring polypeptide (e.g, naturally occurs in bacterial and/or archaeal cells), such as a nuclease. In other cases, an Argonaute polypeptide can be or can comprise a non-naturally-occurring polypeptide, such as a nuclease. A non-naturally occurring polypeptide can be engineered. An engineered Argonaute polypeptide can be a chimeric nuclease, mutated, conjugated, or otherwise modified version thereof. In some cases, an Argonaute polypeptide can comprise a sequence encoded by any one of SEQ ID NO: 1 to SEQ ID NO: 19. In some cases, a polypeptide sequence of an Argonaute polypeptide can comprise a sequence encoded by any one of SEQ ID NO: 20 to SEQ ID NO: 38. In some cases, a polypeptide can comprise a sequence encoded by any one of SEQ ID NO: 39 to SEQ ID NO: 57. In some cases, a construct can comprise a sequence encoded by any one of the sequences of Table 16 (SEQ ID NO: 59-SEQ ID NO: 67), modified versions thereof, derivitaves thereof, or truncations thereof. In some cases, a construct can comprise a sequence encoded by any one of the sequences of Table 17 (SEQ ID NO: 68-SEQ ID NO: 160), modified versions thereof, derivitaves thereof, or truncations thereof. In some cases, a construct can comprise a sequence encoded by any one of the sequences of Table 18 (SEQ ID NO: 161-SEQ ID NO: 252), modified versions thereof, derivitaves thereof, or truncations thereof. In some cases, a construct can comprise a sequence encoded by any one of the sequences of Table 19 (SEQ ID NO: 253-SEQ ID NO: 344), modified versions thereof, derivitaves thereof, or truncations thereof.

In some cases, an Argonaute nucleic acid or portion thereof can comprise a percent identity to any one of SEQ ID NO: 1 to SEQ ID NO: 19, or SEQ ID NO: 39 to SEQ ID NO: 57 from at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, up to at least about 100%. In some cases, an Argonaute polypeptide or portion thereof can comprise a percent identity to any one of SEQ ID NO: 20 to SEQ ID NO: 38 from at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, up to at least about 100%. In some cases, a polypeptide or portion thereof can be from a sequence that comprises a percent identity to any one of SEQ ID NO: 59 to SEQ ID NO: 344 from at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, up to at least about 100%.

TABLE 1

Bacterial Argonaute functional domain nucleic acid sequences identified by PIWI domain

| SEQ ID NO | Sequence |
|---|---|
| 1 | GATCACGTCGCCCACCGCGTCGGCGAAACGTATCGTCACCGGCAATCGATCGTTATGCAGGCAAGAATTGAAATTGATCTTGGT CAGGCCCATCACGTCCCCGAGAACCGTTTCAAGTTCGCAATCTCCGCGGTGAATGCGGACTTCTATCGGATTCGGCGTCTCTGG CCCTTGGGAGGTATCAAGGCGCGGGGCGAATCCCGACGTCCAGAGGAACGCGCGGCGTTCGTGCAATATCAAGGCCGTTCCGCG GATGACCGGATATCGACCGGGCCGGTATAGCTTCATGCGGTCTTTCGCATCGGAAATCTGCACTCCTACGACATTGGTCCCCGG AGCAGCGGCCTTGAAGCCTTTCCATTCCGGGTCCGCGAACGAGGACTTGGCATGAATGAACAGCTCAGCGGGCGGCTGTCCATC ATGCATTTGTTGATATTCGCCGATAACCATCTCAACTAAACTGCTTGCCGCGTCCTCGCTCAGATGAAATTGCTTGGATTCGGA ATGAAACCATGGGCCGAGCGCACCGCGAAATACGACGCCTTCACCGCTCGAAAGAAACATCTGGGCGGCGCAACAGGCGAAGCG ATCATCGGAACTATTGTCCTGTCGCTTATAGGCGAGGCCGACATAGCAAACGCCGGGTCTGACGTCGGCCAACTGCCATGGTCG TCCACCATCCTTGTAATAGGCGCCGGTCAATATTTTCCAGGCGATCGTTGCAGGGTCCTCCAATCGTCGCAGTGGCTTGCCGAT TTTGTTCAGGAAATCGTTAGGCGCCAATGTGGTTTCCCTAACGATCTGAGTGACGATACGGTCTCTGAGCAGACGTGCCTTCAA CTG |
| 2 | GATCTGCATCACCAGCTCAAAGCCTTCACCGCCGCGCGGCAGCTGCCCATTCAGATTGTGCGCGAAGACAGCGCACTATCCTAT CGATGCCGGGCCAGCGTCATGTGGCGGATCGGCCTGGCGCTCTACGCCAAGGCTGGCGGCGTTCCTTGGAAACTGGCCGATGTG GAGCCGGACACTGCCTATATTGGTATCTCCTATGCGCTCCGGCCCGCAGAATCGGAGCTTGCCCGCTTCGTAACCTGTTGCAGC CAGGTCTTCGACGCCGACGGTGCTGGACTGGAATTCATCGCCTATGACACCGGCGATGTGAACGTACAGCGGGAGAACCCGTTT CTCTCGCATACCGAGATGTTTCGGGTCATCACCCGTTCGCTGGACCTTTATCGCCGGCGCCATGGCGGCAGACTGCCGACACGT GTGATGATCCACAAATCGACCGAGTTCAAGGAAGCCGAAATAGAAGGCTGCTTCGAAGCGCTGAAACATATCGAGTCGGTCGAT CTCATCCAGATCGTCGAGGACAATGGCTGGCAGGGCGTGCGATGGGAACAGGACCGTAACGATCCGGAGATATCACAAGCGGAT GGGTATCCGGTGAAACGCGGAACCTTGCTCGGGCTCAGCGGCAAAGACGCTTTGCTCTGGATGCACGGGGCAGTCGATGGTTTC GGGCGCCGCCCCTATTTTCAAGGTGGCAAAGGTACACCGCGACCGTTGCGACTGGTCCGACATGCCGGGCATGGAACATGGGAC GATACCGCGAAGGCGGCCCTGGCGCTGTCGAAAATGAACTGGAACAATGACGGGCTCTATGATCCACTTCCGGTGACGATGAGC TACGCAAAGACCTTAGCA |
| 3 | GATCACGTCGCCCACCGCGTCGGCGAAACGTATCGTCACCGGCAATCGATCGTTATGCAGGCAAGAATTGAAATTGATCTTGGT CAGGCCCATCACGTCCCCGAGAACCGTTTCAAGTTCGCAATCTCCGCGGTGAATGCGGACTTCTATCGGATTCGGCGTCTCTGG CCCTTGGTAGGTATCAAGGCGCGGGGCGAATCCCGACGTCCAGAGGAACGCGCGGCGTTCGTGCAATATCAAGGCCGTTCCGCG GATGACCGGATATCGACCGGGCCGGTATAGCTTCATGCGGTCTTTCGCATCGGAAATCTGCACTCCTACGACATTGGTCCCCGG AGCAGCGGCCTTGAAGCCTTTCCATTCCGGGTCCGCGAACGAGGACTTGGCATGAATGAACAGCTCAGCGGGCGGCTGTCCATC ATGCATTTGTTGATATTCGCCGATAACCATCTCAACTAAACTGCTTGCCGCGTCCTCGCTCAGATGAAATTGCTTGGATTCGGA ATGAAACCATGGGCCGAGCGCACCGCGAAATACGACGCCTTCACCGCTCGAAAGAAACATCTGGGCGGCGCAACAGGCGAAGCG ATCATCGGAACTATTGTCCTGTCGCTTATAGGCGAGGCCGACATAGCAAACGCCGGGTCTGACGTCGGCCAACTGCCATGGTCG TCCACCATCCTTGTAATAGGCGCCGGTCAATATTTTCCAGGCGATCGTTGCAGGGTCCTCCAATCGTCGCAGTGGCTTGCCGAT TTTGTTCAGGAAATCGTTAGGCGCCAATGTGGTTTCCCTAACGATCTGAGTGACGATACGGTCTCTGAGCAGACGTGCCTTCAA CTG |
| 4 | GACCTGCACGACCGGTTGAAGGCGACGGCCGCGCTGCTGGGCGTCCTATCCAGATGATCCGCGAGACCTCCGCGCTGCAGTTC AGGTACAAGTGCTCCATGTACTGGCGGCTGTCGATTGCGCTGCTGACGAAGGCTGGCGGCGTGCCGTTCCGGATGATGCGTCCC ACTGAGTCCGACACTGCCTACCTCGGGCTGGCCTACGCGATTCGCGGCGGACGCGCCAACGAGTTCGTCACCTGCTGCTCGCAG GTCTTCGACGCCGAAGGCGGCGGCTTCGAATTTATCGCCTACAACGTCGGCGCCGACCGTGACCTGGAGAACCCGCATCTGACC CGCGACGAGATGCGCACCGTCATGGCGCGCAGCGCTCGCCTCTACCAGCGGCCAGGGCCGGGTCTCTGCCCCAGCGGCTTGTG ATCCACAAGACGACAACCTGGCGTGAGGAAGAAGTCGCAGGGGTCTTCGACGCGTGGAGCCCGGCCGTTCCTGACATCGAGTGC CTCCAGGTACGTCTAGACACACCCTGGACCGGGGTTGCCCTCCGCGGCGGCAAGGGCAACTCGGCGGTCGCCAACGAATGGCCT GTGGGCCGCGGGTCTCTTCAGTATCTCTCTGGGCGGGAGGCACTCCTGTGGATCGCCGGTACGGCGAAGGGTGTCGCGCTGACG GGTGAGAACTATAATCAGGCAGCCAAGGCTCTACCGACCCCGATTGCGTTCAAGCGTGACGCGGGTGCTGGCCCCCTGGAGATT CCTGCCAGCGAAATCCTTGCCCTGTCGAAGCTCGACTGGAACAACGACGCCCTTTACGGTGTGACCCCG |
| 5 | CATTTCCACAACCAGCTCAGGGCAGGCTACTTGGCTGCGAGGCGATCACCCAGCTCGTGCGCAGACCGCCATTGCCCCGCGCG AATACCTCAACAGCAAGGGCGAGCTTTCCCGCAAGATGCAGGATGACGCACCGTCGCGTGGAATCTCAC |
| 6 | CAAGATGCAGGATGACGCACCGTCGCGTGGAATCTCACGACTGGTGTCTATTACAAAGCGGGCGAGAAGCCGTGGTCTCTTGCC GACATCCGGGATGGCGTCTGCTACACAGGCCTCGTCTTCAAGCGTACAAACAACCCGGTCGAAGCGAAGGAGGCGTGCTGTGGC GCGCAGATGTTCCCTCATACCGGCGAAGGCATCGAACGCCGCGGCTGC |
| 7 | GAGGACATCTCCGACCGCGTTGGCGAAACGGATCGTCACCGGTAACCGGTCATTGTGAAGGCACGAATTGAAGTTGATCTTCGT GAGCCCGAGCACGTCGGCGAGGACCGTCGTCAGTGGGCACTCGCCGCGAAGAACGCGAACCGAAATCGGGTTCGGGGTCTCAGG CCCCATATAGGTGTCCAGCCGTGGCACATAGCCCGAGGTCCACAGAAGTGCGTGACGTTCACCGATCTGCAGCGCCGTGCCGCG AATGACGGGATACTCTCCAGGACGATAGAGCTTCAGGTCATCACGAGCCTCGGCAATCTGCACACCGACGAGGTTGGTCTCATC CCCGCAGGCGGACGAAAAACCGCGCCATTCGTTGTCGGTAAAGGCGGACTTCGCGTGGATGAAGAGTTCGGTTGGTGGGCCATC GTGCAGGCGGGTGTATTCGCCCACCACCATCTTGATAAGGTTCCTGGCGGCATCCTTATCAAGGTGGAACTGCTTCGTATCGGT TTGGAACCAAGGGCCGAGCGCGCCGCGGAAGACCACGCCTTCCCCGTCAGCGAGAAACATTTGGGCTGCGCAGCAGGCATGACG |

TABLE 1-continued

Bacterial Argonaute functional domain nucleic acid sequences identified by PIWI domain

| SEQ ID NO | Sequence |
|---|---|
| | CTTGTCGCTTGTTAGTTCGCTGCGTTTGTAGACCAGTCCGACATAACAGACGCCCGGTCGAACATCGGCCAACTGCCAAGGCTT CCCGCCAGCCTTGTAGTAGGCGCCCGTTCCCATTTTCCAGGCGATAGTCGC |
| 8 | GATGCTCACGACACACTCAAGGCATTGGGCGCGAAATATAATATACCAACGCAGGTGCTCAATGACCGTGTCTTTGCGTTTTCA CACCCTGCGTCGCGATCCTGGCGGCTGGCGATAGCGCTTTATGTTAAGGCAGCGGGCACACCTTGGAAGCTTGCGCCCCTGAAA GGTGTACCTGAGGACACGGCTTACATCGGCCTCGCCTACGCCTTACGGGGCGACCAGCGGGATGCGCACTATGTGACGTGCTGT TCCCAGGTGTTTGATATGGATGGCGGAGGAATGCAGTTCGTTGCCTTCGAGGCCAAGGATCCTATCGCCGATGTCGCAGAAGCG CGTCGAAATCCATTTCTCAGTCGAGATGATATGCGCGCGGTTCTTGCTCGCAGCCTCGAGCTTCTATCAAGGAAGAAATGGAGGA ACACTGCCGAAGCGGCTTGTCATTCATAAGACCACAGCATTCAAACCGGATGAGATCGAGGGTGCGTTTGATGCACTTGCCGGG GTGCAAGAAATCGAGTGCATTGAAGTTAGCCCAGCTTCCGGTTGGCGTGGGGTATGGCTGGTACCGAGCGGACAGCCGAAGCCG CCGACCAAGCCTGCGGGCTACCCTGTTCCGAGAGGCACCGTTGTCGTCCGGTCCGGGACCTCGGCGCTTGTTTGGGTCGCGGGC AATGCTCCCGAAGTGTCTAATAAGGGCGACTATTATCAGGGAAAGAAGAGCATTCCAAAGCCGTTGCAGCTGATCAGGCACGCA GGCAGTGGACCGTTGGAGCTATCGGCTCACGAGGCCTTGGCTCTCACCAAGATGGATTGGAACAATGATGCTCTCTACGATCCT GTGCCTGTTAGCATCCGATACTCGCAACGCTTAGCCAAGACGATC |
| 9 | GATCTACACGATTTCGTCAAGGCGGCGGCGATTCCGAAAGGTTGCGCCACACAGTTTGTCGAAGAGGACACCCTCCGTAACACG CAGCAGCAATGCCGCGTGCGCTGGTGGCTCTCGCTTGCCCTGTACGTGAAAAGCATGCGCACGCCGTGGACTTTGGAAGGCCTC AGCGAGAAATCCGCCTACGTGGGTCTCGGCTTCAGCGTCAAACGCAAGACGACACAGAATGCGGGCGCACACGTCGTGCTGGGC TGTAGCCACCTCTATAGCCCGAACGGCATCGGTCTGCAGTTCCGCCTGAGCAAGATCGAAGATCCAATTATGCGCAACAAGAAT CCCTTCATGAGCTTCGACGATGCAAGACGGCTCGGTGAGGGCATCGTGAACTGTTTTTCGCCGCCCAACTTCGACTTCCTGAG CGAGTGGTGATCCACAAGCAGACCCCATTCCTTCGCGAAGAACGCAGTGGGCTCCAGGCTGGACTCGAGGGAGTTGCGTGCGTA GAGCTATTGCAGATCTTCGTTGACGACACGCTACGGTATGTGGCGTCCATCCGACCTCCGACGGAAAGTTCGAGACCGACAAC TATCCCATCCGGCGGGGAACGACAGTGGTCATCGACGATCACACGCTCTTCTGTGGGTCCACGGCGCATCTACTGCACTAAAT CCCAGAAGGCTATTTTCCAGGGCAAGCGTCGAATTCCAGCCCCCTTGGTAATTCGGCGTCATGCGGGCACGACCGATTTGATG ACGATCGCCGACGAAGTTCTCGGCTTGTCGAAGATGAATTTCAACAGCTTCGACCTTTACGGGCAACTTCCAGCGACGATCGAG ACGTCACGCCGCGTTGCGAAGATC |
| 10 | ACCGATGCGCGCGACCCGTTGAGAGGTTTCGATGGTTGCGGGCAACTGCCCATAGAGATCAAAGCTGTTGAAGTTCATCTTGGA CAGGCCAAGGATTTCATCGGCCAGCATCATGAGATCGCTAGTGCCGGCGTGGCGGCGCATCACGAGCGGGCCGGAATTCGGCG CTTCCCCTGAAAGTAGGATTGCCTAGGGTTGAGAGCGGTAGAGGTTCCGTGCACCCACAGCAATGCTGTCTGATCGTCCACTAC AACCGTTGTGCCGCGTCGAATCGGATAGCCGTGAATCTCGAAGTCGCCATTGGGCATCGGGCGCGATGCCACGTACCGCAAGGT GTCATCGACGAAGATCTGCAACAACTCGACGCAGGCCACGCCCTCCAGGCCAGCTTGCAGCCCCTCGCGCTCCTCCTTCAGGAA AGGCGTTTGCTTGTGCACCACGACGCGATTGGGAAGGCGTAGGTGGGCGTGAAGAACAGCTCTCGGATGCCTTCCCCAAGCTT TCGCGCGTCGTCGAAGCTCATGAAGGGGTTCTTGCGCAGCATGATCGGGTTGTCGATCTTGCTCAGGCGGAATTGAAGGCCGTG ACCATTGGGCTGTAGAGGTGGCTGCAGCCCAGCGCGACATGGCCTTCGCCGTCGATCTTTCGGCGGACGCTGAAGCCGAGGCC CACGAAGGCGGAATCCCTATCAAGGCCGGTGAGGGCCCAGGGGGTGCGCATGGCTTTCACGTACACAGCCAGAGACAACCACCA TCGAACGCGGCATTGCTGACCGTTGGCGAGAGTGCTTTCTTCGAGAAACTGAGTGGAGCAACCAGCCGGGATGGCCGCGGCCTT CACAAAATCGTG |
| 11 | GATCACGTCGCCCACCGCGTCGGCGAAACGTATCGTCACCGGCAATCGATCGTTATGCAGGCAAGAATTGAAATTGATCTTGGT CAGGCCCATCACGTCCCGAGAACCGTTTCAAGTTCGCAATCTCCGCGGTGAATGCGGACTTCGGATCTCGGCGTCTCTGG CCCTTGGTAGGTATCAAGGCGCGGGGCGAATCCCGACGTCCAGAGGAACGCGCGGCGTTCGTGCAATATCAAGGCCGTTCCGCG GATGACCGGATATCGACCGGGCCGGTATAGCTTCATGCGGTCTTTCGCATCGGAAATCTGCACTCCTACGACATTGGTCCCCGG AGCAGCGGCCTTGAAGCCTTTCCATTCCGGGTCGCGAACGAGGACTTGGCATGAATGAACAGCTCAGCGGGCGGCTGTCCATC ATGCATTTGTTGATATTCGCCGATAACCATCTCAACTAAACTGCTTGCCGCGTCCTCGCTCAGATGAAATTGCTTGGATTCGGA ATGAAACCATGGGCCGAGCGCACCGCGAAATACGACGCCTTCACCGCTCGAAAGAAACATCTGGGCGGCGCAACAGGCGAAGCG ATCATCGGAACTATTGTCCTGTCGCTTATAGGCGAGGCCGACATAGCAAACGCCGGGTCTGACGTCGGCCAACTGCCATGGTCG TCCACCATCCTTGTAATAGGCGCCGGTCAATATTTTCCAGGCGATCGTTGCAGGGTCCTCCAATCGTCGCAGTGGCTTGCCGAT TTTGTTCAGGAAATCGTTAGGCGCCAATGTGGTTTCCCTAACGATCTGAGTGACGATACGGTCTCTGAGCAGACGTGCCTTCAA CTG |
| 12 | GACGCCCACGACGCGTTGAAGGCCCTTGGAGCCCGGTACGCCATCCCAACGCAGGTCATCAACGATCGCGTTTTCACATTCCGG CTCAAGGCGTCGTTGGCCTGGCGCCTGGCCATCGCGCTCTTCACCAAGGCGGGCGGCATTCCCTGGAAACTCGCGCCGATGGTC GGTGTACCAGAAGCACGGCCTATATCGGTCTCGCCTACGCGTTGCGCGGGACCCCAAGTCCGCGCAGTTCGTCACGTGCTGC TCGCAGGTGTTCGACGCGGACGGCGGTGGCATGCAGTTCGTCGCTTTCGAGGCCAAGGAGCAGGTGGCGGATCCGCGCGAAGCC AGACGGAACCCGTTTCTCAGTCGGAGCGACATGCGGGCGGTAATGGCACGTAGCCTGAGCCTCTACCTTGGGCGTAATGGTGGA CGGCTGCCGCGACGTCTCGTCGTCCACAAAACGACGTCGTTCAAGGACGAAGAACTCCAAGGCGTTTTCGACGGCCTGTCGACG GTTCCAGAGGTGGAGTGCATCGAGATCGGCAGCAGCGCCACATGGCGTGGCGTGTGGCTGAAGCAGGGAAAGAAGGGCGGACCC AAAAGTGTGCCTGATCGAGCGCCGGTGCCGCGGGAACTGTCCTCACGCGAACGGACCGGTCGGCGCTGTTGTGGGCATCGGC AATGCCCCGTCGGCAGCGCTCAGCGGTGCCTTGTTTTTCCAGGGAAGCAAGAGCATTCCGCGCCCGCTCAACATCATCGTCAC GCGGGCAGCGGTCCGCTGGAAGTTGCTGCGTTGGAAACCCTCGCGCTGACCAAAATGGACTGGAACAACGACGCGTTGTACGAC CCGGTTCCGGTGACCATTCGCTATTCGCAACGGCTCGCACGTACCATC |
| 13 | AGCCCTTACTGGTGGGCGAAGGCTGCGTTCCTGCGGCGCGACGTGCCAGTGCAGGCACTCTCCGCCGAGATGATGGCCATGGGC GACTTCGAGTACGCCTGCGCTTTGGCAAACGTCAGCTTGGCCACTTACGCCAAGCTCGGCGGTACCCCTTGGCTGCTGAAGGCC CGGCCCTCGACAGATCACGGAGCTTGTCTTTGGCCTCGGATCTCATACCCACAAGGAGCGACGTCGAGGTGCAGGGGAACGGGTC GTCGGGATCACGACCGTGTTCTCTAGCCAGGGTAACTATCTACTAGATGCCGAACGGCTGCAGTACCGTTCGACGCTACCCG GAGGCACTGCGCGCCACGCTCATCGAGGCGGTCAAGCGCATACGGCAAGAGGAGGCCTGGCGCGCGGGCGACACGGTGCGCTTG GTCTTCCATGCCTTCACCCAGATGCGACAAGAGACTGCGGATGCCGTGGTTGCCGCTGTGGAAAGCATGGGCCTGAGTGGGGTG AAGTTCGCCTTCCTCCATGTGGCCGAGGACCACCCATTCACGCTGTTGACCACGCCTCAGCGACTGGCAAGGGTGCCTATGCG CCCGAGCGTGGGCAGGCCGTAGAACTCAGCGACCACGAGTGGCCTCTTTCCCTCACCGGACGGGATCAGATCAGAGCCGCGTCG CAGGGCATCCCTGATCCGGTGCTACTCCGCCTGCACGAGAAATCGACCTTTCGCGACATGCGAACGCTGACGCGTCAGGTATCG GATTTCGCCTGCCACTCCTGGCGTACTTACGAACGAGCTAGGCTCCCGATCACACTCCTCTAC |

TABLE 1-continued

Bacterial Argonaute functional domain nucleic acid sequences identified by PIWI domain

| SEQ ID NO | Sequence |
|---|---|
| 14 | GATCACGTCGCCCACCGCGTCGGCGAAACGTATCGTCACCGGCAATCGATCGTTATGCAGGCAAGAATTGAAATTGATCTTGGT CAGGCCCATCACGTCCCCGAGAACCGTTTCAAGTTCGCAATCTCCGCGGTGAATGCGGACTTCTATCGGATTCGGCGTCTCTGG CCCTTGGTAGGTATCAAGGCGCGGGGCGAATCCCGACGTCCAGAGGAACGCGCGGCGTTCGTGCAATATCAAGGCCGTTCCGCG GATGACCGGATATCGACCGGGCCGGTATAGCTTCATGCGGTCTTTCGCATCGGAAATCTGCACTCCTACGACATTGGTCCCCGG AGCAGCGGCCTTGAAGCCTTTCCATTCCGGGTCCGCGAACGAGGACTTGGCATGAATGAACAGCTCAGCGGGCGGCTGTCCATC ATGCATTTGTTGATATTCGCCGATAACCATCTCAACTAAACTGCTTGCCGCGTCCTCGCTCAGATGAAATTGCTTGGATTCGGA ATGAAACCATGGGCCGAGCGCACCGCGAAATACGACGCCTTCACCGCTCGAAAGAAACATCTGGGCGGCGCAACAGGCGAAGCG ATCATCGGAACTATTGTCCTGTCGCTTATAGGCGAGGCCGACATAGCAAACGCCGGGTCTGACGTCGGCCAACTGCCATGGTCG TCCACCATCCTTGTAATAGGCGCCGGTCAATATTTTCCAGGCGATCGTTGCAGGGTCCTCCAATCGTCGCAGTGGCTTGCCGAT TTTGTTCAGGAAATCGTTAGGCGCCAATGTGGTTTCCCTAACGATCTGAGTGACGATACGGTCTCTGAGCAGACGTGCCTTCAA CTG |
| 15 | GATCACGTCGCCCACCGCGTCGGCGAAACGTATCGTCACCGGCAATCGATCGTTATGCAGGCAAGAATTGAAATTGATCTTGGT CAGGCCCATCACGTCCCCGAGAACCGTTTCAAGTTCGCAATCTCCGCGGTGAATGCGGACTTCTATCGGATTCGGCGTCTCTGG CCCTTGGTAGGTATCAAGGCGCGGGGCGAATCCCGACGTCCAGAGGAACGCGCGGCGTTCGTGCAATATCAAGGCCGTTCCGCG GATGACCGGATATCGACCGGGCCGGTATAGCTTCATGCGGTCTTTCGCATCGGAAATCTGCACTCCTACGACATTGGTCCCCGG AGCAGCGGCCTTGAAGCCTTTCCATTCCGGGTCCGCGAACGAGGACTTGGCATGAATGAACAGCTCAGCGGGCGGCTGTCCATC ATGCATTTGTTGATATTCGCCGATAACCATCTCAACTAAACTGCTTGCCGCGTCCTCGCTCAGATGAAATTGCTTGGATTCGGA ATGAAACCATGGGCCGAGCGCACCGCGAAATACGACGCCTTCACCGCTCGAAAGAAACATCTGGGCGGCGCAACAGGCGAAGCG ATCATCGGAACTATTGTCCTGTCGCTTATAGGCGAGGCCGACATAGCAAACGCCGGGTCTGACGTCGGCCAACTGCCATGGTCG TCCACCATCCTTGTAATAGGCGCCGGTCAATATTTTCCAGGCGATCGTTGCAGGGTCCTCCAATCGTCGCAGTGGCTTGCCGAT TTTGTTCAGGAAATCGTTAGGCGCCAATGTGGTTTCCCTAACGATCTGAGTGACGATACGGTCTCTGAGCAGACGTGCCTTCAA CTG |
| 16 | AACCCGTACTACACCACTAAAGCGCGATTGATGGCGCAAGGTGTTCCAGTACAACTATTGAATATCGAAACCATCCGTCGAAAA AGCCTTGACTACATTCTCAATAATATCGGGCTTGCTATGTACGCGAAGCTTGGCGGAATCCCTTGGACGCTGACCCAGAACAGC GATATGGCGCACGAGATTATCGTTGGTATAGGAAGCGCCAGATTGAACGAAAGCGTCGTGGTGCAGGCGAGCGGGTGATCGGA ATTACGACCGTTTTCAGCGGCGATGGCCAGTACCTGTTGGCAAACAATACTCAAGAGGTGCCTTCAGAAGAGTACGTTGATGCT CTGACTCAGTCTCTCTCGGAGACTGTGAGTGAACTCAGGAGCCGATTCGGTTGGAGACCAAAAGACAGGGTCCGATTCATCTTC CATCAAAAGTTCAAGAAGTACAAAGATGCTGAAGCTGAGGCAGTTGATCGCTTCGCACGATCACTCAAAGATTTCGACGTGCAA TATGCCTTCGTTCATGTCAGTGACTCGCACAACTGGATGTTGCTAGATCCCGCATCGAGGGGAGTGAAGTTCGGCGACACAATG AAGGGAGTGGCGGTCCCGCAGAGGGGACAATGTGTGCCTCTAGGGCCAAACGCTGCTCTTTTGACTTTGTCGGGCCATTTCAG GTCAAGACGCCACTGCAAGGTTGCCCTCATCCAGTACTGGTGAGCATTCACGAGAAGTCCACGTTCAAGAGCGTGGATTATATC GCTCGCCAAATTTTCAATCTCAGCTTCATCTCATGGAGGGGTTTCAACCCGTCAACGCTTCCAGTTTCGATTTCTTACTCAGAC ATGATCGTAGATCTGTTG |
| 17 | AATTTTAGAAGAGCATTAAAAGCCCGTGCAATGAAATACAACACACCTATTCAGTTGTTGAGAGAATATGTAATGCACGACAGT AACAAATCACAAGATAATGCAACTAAGGCATGGAATTTTTGCACTGCTGTTTATTATAAGGGACTTCAAACCATTCCTTGGAAG TTGGFAGTAGACGAGFACAAACCAAAAGTATGTTTTGTAGGTATTGGATTCTACAAAAGCAGGGACAAGAAAACGATTCAAACC AGTTTAGCACAAATTTTCAATGAAAATGGAAAAGGTGTGATACTTCGCGGAACTCCTGTAACTGAAGATAAAGACGATAAAAAA CCTCACTTAACTTATGAGCAATCTTTAAGCCTTCTGAAAGATGCCTTGACCAAATACAAGTTTGCGACAGGTTCAATGCCAGGT AGAGTAGTTTTACACAAGACTTCAAAATACTATGAGGATGAACTTGACGGCTTTATTCAAGCAATGCAGGATTTGGGTATAACT GAATACGATATTGTAACTATCATGGAAACCGATTTGCGTTTCTTTAGAAATAATCTTTATCCACCAGTGAGAGGGGCAGTTTTT TCATTGACTGAACAAAGACACATACTTTACACTAGGGGTTCAGTTCATCAATATCGACATATCCAGGAATGTATATTCCTGCT CCATTAGAAGTAAGAATAGTAAGTTCCGTTTCATCTATAAGGACAGTTTGTAAAGAAATTCTTGGCTTGACAAAAATGAATTGG AACAACACCCAATTCGACAACAAATACCCCATTACAATTGGCTGTGCAAGACGGGTAGGAGAAATAATG |
| 18 | AAGAACCTCACCAACCTTTCGTGCGACCCGGATGGGAATGGGCAGCTTCTGGTTCATCTGGGTCGAATTCCAGTTGATCTTCGT CATCGACAGCACGTCTTTGGCGATCTGCGCGACGGTGCTGTCGCTGCTTTTGTGCGGACATAGCAGAAATGGCCTGGGATCATA CTGGCCTGGATAGGTTCCGTAGTACGGGATGCTGCCGTTCGTATAGAGAAGCCCTTTCCCGTCGAGTTCGACAAAGGTGCCGCG CATCACGGGATAGTTCCCGTCGCGGAGGACTTTCACCGACGAGGATTCCTGGACCCATACAAGGTCCTTCATCTCCGTGCCCGC AGCGTCGAGCGCCTCCACGTTCCGTCCGCTTCCTCGTCACGGAAACGCGAGGTTTTCAGGACGGCGACACGGACCGGGTAGTGC CGATGATGGTTCTTGTAGGCGGTCAGCACCGC |
| 19 | GATTTTCACCGCCAGGTGAAAGCGCGTCTGCTCAAGCTAGGTCGCACTTCGCAACTCATCCGCGAAACGACGTTGGCACCCGAC AAATTCCTAAATAACGCGGGCTATCCAAAGCGTGGGTTGCAGGATCCGGCGACAGTGGCGTGGAATCTGGCAACTGGACTTTAC TACAAAACCCAACCCTTGCCGCCGTGGAAACTCGCGCATGTCAGGCCGGGCGTTTGTTACATCGGACTTGTTTTCAAGATGATT CCGAATGATCCAAAGGAACATGCCTGCTGTGCGGCGCAGATGTTTCTTAATGAGAGCGACGCCGTTGTTTTCAGGGGCGCAAAT GGCCCGTGGAAAACCGACGACTTTGAATTCCACCTTCAACCCAAAGAGGCGCAAAGCCTGATTGCCAAAGTGCTCAAAACCTTC GAGGAGAAGCACGGTGTGCCACCAAAGGAATTTTTCATCCACGGGTGCACAACCTTCAACGAGGATGAATGGAAAGCCTTCAAA AAGGCCACGCCGAAGGGCACCAATCTTGTCGGCGTCCGCATCAAGGAAACCAAAGGGGAATCCAAGCTGTTCCGTGATGGTGAT TATCCGGTAATGAGGGGAACGGCCATCATTCTTGATCACCGAAACGCCTTGCTGTGGACGAATGGATTTGTGCCACGGCTGGAC ACCTATATTGGGCCTGAGACGCCAAACCCGCTTTTGATAACCGTTCTGCGTAGTACGGGTCGGCGACCTAACATTCGCACCGTT CTTGCTGACATCATGGGCCTTACCAAGATCAACTACAACGCCTGCAACTACAATGACGGATTGCCCGTCACGATCCGCTTTGCG AGCAAGGTGGGCGATGTGCTG |

TABLE 2

Corresponding Argonaute domain polypeptide acid sequences to those disclosed in Table 1 that were identified by PIWI domain

| SEQ ID NO | Sequence |
|---|---|
| 20 | MLEFRYGQRMVYPRDGLFLFGPGDGGRAPINFGVIGTPAGVARFRQWMGSVGNVIDAANDDPQHVPFPGYGAAFASAWPDKPRHII<br>DSIDPAAVSRALRLENRNEAIKSTVDLYVDPLVAAADRLEAPPNFWFVVIPEEIYKLGRPQSSVPKADRIRGSVKLSKSAARDLML<br>EPTFFPEDLEAAEIYQYATHFRRQLKARLLRDRIVTQIVRETTLAPNDFLNKIGKPLRRLEDPATIAWKILTGAYYKDGGRPWQLA<br>DVRPGVCYVGLAYKRQDNSSDDRFACCAAQMFLSSGEGVVFRGALGPWFHSESKQFHLSEDAASSLVEMVIGEYQQMHDGQPPAEL<br>FIHAKSSFADPEWKGFKAAAPGTNVVGVQISDAKDRMKLYRPGRYPVIRGTALILHERRAFLWTSGFAPRLDTSQGPETPNPIEVR<br>IHRGDCELETVLGDVMGLTKINFNSCLHNDRLPVTIRFADAVGDVILAAPRTGEPKLPFKYYI |
| 21 | MTSQLQHYVRLPEPNLLFHPDRPSDRDIHPLRGLARFGPYSSMFTPSPIRVATLAPSGESQRLFEFLRELNQPARPQERTDYLPDW<br>ASFNSVFQTHLAPAASHCRRELDAQLDGELKDCPASGLLLAERLIRSIQLLDANRADFDVLFIYLPERWSPGFYGADDFDLHHQLK<br>AFTAARQLPIQIVREDSALSYRCRASVMWRIGLALYAKAGGVPWKLADVEPDTAYIGISYALRPAESELARFVTCCSQVFDADGAG<br>LEFIAYDTGDVNVQRENPFLSHTEMFRVITRSLDLYRRRHGGRLPTRVMIHKSTEFKEAEIEGCFEALKHIESVDLIQIVEDNGWQ<br>GVRWEQDRNDPEISQADGYPVKRGTLLGLSGKDALLWMHGAVDGFGRRPYFQGGKGTPRPLRLVRHAGHGTWDDTAKAALALSKMN<br>WNNDGLYDPLPVTMSYAKTLAQVIKRMPGLGKGTYQFRFFM |
| 22 | MLEFRYGQRMVYPRDGLFLFGPGDGGRAPINFGVIGTPAGVARFRQWMGSVGNVIDAANDDPQHVPFPGYGAAFASAWPDKPRHII<br>DSIDPAAVSRALRLENRNEAIKSTVDLYVDPLVAAADRLEAPPNFWFVVIPEEIYKLGRPQSSVPKADRIRGSVKLSKSAARDLML<br>EPTFFPEDLEAAEIYQYATHFRRQLKARLLRDRIVTQIVRETTLAPNDFLNKIGKPLRRLEDPATIAWKILTGAYYKDGGRPWQLA<br>DVRPGVCYVGLAYKRQDNSSDDRFACCAAQMFLSSGEGVVFRGALGPWFHSESKQFHLSEDAASSLVEMVIGEYQQMHDGQPPAEL<br>FIHAKSSFADPEWKGFKAAAPGTNVVGVQISDAKDRMKLYRPGRYPVIRGTALILHERRAFLWTSGFAPRLDTYQGPETPNPIEVR<br>IHRGDCELETVLGDVMGLTKINFNSCLHNDRLPVTIRFADAVGDVILAAPRTGEPKLPFKYYI |
| 23 | MTLDFDSRQPWAPHTILQEPMLKFDSSPTPATAGHPLVGLLDHGPYAGPPTASVRLATITLNGDKPKLYDFLRGATQAHEPSDRLA<br>YVPRYPGFEALFKAELLPQSDAHVDIRSAEIGTGADAHDRLSEALARAVRHLHTVRDSWDVIVFLLPAAWEPLRLSADGALDLHDR<br>LKATAALLGCPIQMIRETSALQFRYKCSMYWRLSIALLTKAGGVPFRMMRPTESDTAYLGLAYAIRGGTANEFVTCCSQVFDAEGG<br>GFEFIAYNVGADRDLENPHLTRDEMRTVMARSARLYQRRRAGSLPQRLVIHKTTTWREEEVAGVFDAWSPAVPDIECLQVRLDTPW<br>TGVALRGGKGNSAVANEWPVGRGSLQYLSGREALLWIAGTAKGVALTGENYNQAAKALPTPIAFKRDAGAGPLEIPASEILALSKL<br>DWNNDALYGVTP |
| 24 | VEMVFEQVLLRGHIGVVEEDALALYRYLEKKPISPCGARI |
| 25 | LTGAVFAAAAFDAFAGMREHLRATARLLRFDRVVCTLEDEACVADAIPDVGKRPRLLARFVIDTSREIPRDGASSCILRESSPLLL<br>RYSRGAMAVCARAG |
| 26 | MTTRPRSFKPQMLYLEEPQLEFRHGQHLVYPRDGLYLYGPVGETKELPTIRYGVIGTPDGVGRFKAWAQSMAGFIDIPPPGPRSRA<br>VEPQHVPFPGFAAAFHADWPVEPPYIIDSLDPDEIEQTLRIANRHEAVRNTVDMFVSRLVAENNRLESAPQFWFVVIPEKVYELGR<br>PKSTVRRDDRVAGEVTISQRRAKELQRQPTLFGEDEREAEVYQVRAKLKARLLKERIVTQIVRETTLAPGDFRRESGMPIRR<br>VEDPATIAWKMGTGAYYKAGGKPWQLADVRPGVCYVGLVYKRSELTSDKRHACCAAQMFLADGEVVFRGALGPWFQTDTKQFHLD<br>KDAARNLIKMVVGEYTRLHDGPPTELFIHAKSAFTDNEWRGFSSACGDETNLVGVQIAEEARDDLKLYRPGEYPVIRGTALQIGERH<br>ALLWTSGYVPRLDTYMGPETPNPISVRVLRGECPLTTVLADVLGLTKINFNSCLHNDRLPVTIRFANAVGDVLISAPMDGEPKLPF<br>KFYI |
| 27 | MASLQGSHQPSDRLEYVPPYPGFESLFGIALQSAPAEAHVKWPDAIRDLPGEGNDQVRLFLAMDAALRRLDTMRNEFDVVLFHFPD<br>SWDATTRTKFFDAHDTLKALGAKYNIPTQVLNDRVFAFSHPASRSWRLAIALYVKAAGTPWKLAPLKGVPEDTAYIGLAYALRGDQ<br>RDAHYVTCCSQVFDMDGGMQPVAFEAKDPIADVAEARRNPFLSRDDMRAVLARSLELYQGRNGGTLPKRLVIHKTTAFKPDEIEG<br>AFDALAGVQEIECIEVSPASGWRGVWLVPSGQPKPPTKPAGYPVPRGTVVVRSGTGSLVWVAGNAPEVSNKGDYYQGKKSIPKPLQ<br>LIRHAGSGPLELSAHEALATLKMDWNNDALYDPVPVSIRYSQRLAKTIANVPDLPRNVYPYRLFM |
| 28 | VDALVRSLAVSQDRPLMLFLGAGASMTSGMPSANQCIWEWKRDIFLSNNPGIEEQFSELSLPSVRDRIQTWLDRQRCYPVAGHPDE<br>YGAYIEACFSRSDDRRRYFERWVKQSTPHTGYRLLAELAASGLIQTVWTTNFDGLIARAAVATNLTSIEIGIDSQQRLYRAPGKDE<br>LACVSMHGDYRYDRLKNSPGELAQVEVQLRDSLIEALRTHTVVVAGYSGRDESVMQAFRQYAASGPARTDLPLFWTQYGEDPPLDT<br>VSAFLSTNDDEPSRFIVPGVSFDDLMRRLALYLSKGPARDRVNKILDEHATTPVNQLTAFGLPPLPPTGLIKSNAIPLTPPQELLE<br>FDLHQWPASGTVWATLRELGDKHNFVAAPFRSKIYAIAIAESLRLAFGENLKGEIKRVPLNDDDLRYEDGVINQLVRRATVLALSA<br>KANCPSDGESLIWTSEKVENLRLDRVDWKVHQAVLVQIRPLGTEMALVLKPTLYVTDKSGAIAPKDTERLVKQRVLGYQHNKEFND<br>ATEAWRRRLVPQRDFHVRFPDHEDGIDLTFSGRPLFARITDERERTVSLSSAQELAARQAGLQLAEPRLKFARKSAAGLAFDTHPV<br>RGLINNRPFDSSLTTTGIASSIRVGIIAPAQDATRVHQYLSQLHVAAQPGKDADYLPPFPGFASAYQCPLEIPAVGEQSFVQLDEP<br>DSMTPSSARALAGAITRSIASLSASQRPDVTIIYVPDRWAPLRNYMIDDEEFDLHDFVKAAAIPKGCATQFVEEDTLRNTQQQCRV<br>RWWLSLALYVKSMRTPWTLEGLSEKSAYVGLGFSVKRKTTQNAGAHVVLCGSHLYSPNGIGLQFRLSKIEDPIMRNKNPFMSFDDA<br>RRLGEGIRELFFAAQLRLPERVVIHKQTPFLREERSGLQAGLEGVACVELLQIFVDDTLRYVASHPTSDGKFETDNYPIRRGTTVV<br>IDDHTALLWVHGASTALNPRRHYFQGKRRIPAPLVIRRHAGTTDLMTIADEVLGLSKMNFNSFDLYGQLPATIETSRRVAKIGALL<br>DRFSEHSYDYRLFM |
| 29 | MSVDAMIRSIGVARDRPLLVFLGAGASMSSGMPSATQCIWEWKREIFLTNNPDVEKTQFSELSLPSVRLRIQAWLDRQRRYPALDH<br>PDEYSTYIGECFARSDDRRIYFEKWVKRCSPHLGYQLLAELARQGLVASVWTTNFDALAARAATSINLTAIEIGIDSQQRLYRAPG<br>EAELACVSLHGDYRYDPLKNTAPELIKQEKELRESLVQAMRTHTVLVCGYSGRDESVMAAFSDAYDAAHFKGHHPLFWTQYGDYPA<br>SEPVAGLLASPLDQEPAKFHVPGASFDDLMRRIALHVSDGEARERVRKILENFKTAPVNQKLPFALPSLPVTGLVKSNAIPLIPPG<br>ELIEFDLVRWPPSGEVWSTLREIGDRHGFVAAPFRGKVYALATIEQLTQAFADNVKDPGAFNRVPLNNDDLRYEDGTANQLMRRATV<br>LALAGKAGCANDGDAIVWDTSRSKTERLDRQLWTVYDAVLLQIRPLGTKLALVLKPTLRVTDSTGEVAPKEIERAVKVRVLGYQHN<br>KEFNQATDFWRKRLLPSRDLLVRFPDLDGGMTFTISGRPIFARLTDERTETVTLNDAQERSASQVGLQLAEPKLVFARTVGTGPAT<br>DTLPVRGLLQNRPFDANLTDLGIATNLRIAVIAPARDARRVHQLSQLHVAAQPGKDADYLPPFGFSSAFKCPLDIPQPGQAAF<br>VTLDEPHDESPQSARTLAGRITAALSALRATENPSVTIIYIPARWHALRAFDLESEQFNLHDFVKAAAIPAGCSTQFLEESTLANG<br>QQCRVRWWLSLAVYVKAMRTPWALTGLDRDSAFVGLGFSYVRRKIDGEGHVALGCSHLYSPNGHGLQFRLSKIDNPIMLRKNPFMSF<br>DDARKLGEGIRELFFDAHLRLPNRVVVHKQTPFLKEEREGLQAGLEGVACVELLQIFVDDTLRYVASRPMPNGDFEIHGYPIRRGT<br>TVVVDDQTALLWVHGTSTALNPRQSYFQGKRRIPAPLVMRRHAGTSDLMMLADEILGLSKMNFSFDLYGQLPATIETSQRVARIG<br>ALLDRYTERSYDYRLFM |

TABLE 2-continued

Corresponding Argonaute domain polypeptide acid sequences to those disclosed in Table 1 that were identified by PIWI domain

| SEQ ID NO | Sequence |
|---|---|
| 30 | MLEFRYGQRMVYPRDGLFLFGPGDGGRAPINFGVIGTPAGVARFRQWMGSVGNVIDAANDDPQHVPFPGYGAAFASAWPDKPRHII DSIDPAAVSRALRLENRNEAIKSTVDLYVDPLVAAADRLEAPPNFWFVVIPEEIYKLGRPQSSVPKADRIRGSVKLSKSAARDLML EPTFFPEDLEAAEIYQYATHFRRQLKARLLRDRIVTQIVRETTLAPNDFLNKIGKPLRRLEDPATIAWKILTGAYYKDGGRPWQLA DVRPGVCYVGLAYKRQDNSSDDRFACCAAQMFLSSGEGVVFRGALGPWFHSESKQFHLSEDAASSLVEMVIGEYQQMHDGQPPAEL FIHAKSSFADPEWKGFKAAAPGTNVVGVQISDAKDRMKLYRPGRYPVIRGTALILHERRAFLWTSGFAPRLDTYQGPETPNPIEVR IHRGDCELETVLGDVMGLTKINFNSCLHNDRLPVTIRFADAVGDVILAAPRTGEPKLPFKYYI |
| 31 | MDYNLSKAPSFSLLDEPALTFNSEDTDLDENPLRGLLRFGAYNGKTFEGYTPKLRVATIAPASGWPKLKGLVDTIRSGHEASDRRN YVPSFPGFENLFRVPLVAGPKDVHIKWPDDLMALARTGAPHERLFSAMSEAMARLDALHDQFDVVLVHLPDAWATAFTANGFDAHD ALKALGARYAIPTQVINDRVFTFRLKASLAWRLAIALFTKAGGIPWKLAPMVGVPEDTAYIGLAYALRGDPKSAQFVTCCSQVFDA DGGGMQFVAFEAKEQVADPREARRNPFLSRSDMRAVMARSLSLYLGRNGGRLPRRLVVHKTTSFKDEELQGVFDGLSTVPEVECIE IGSSATWRGVVWLKQGKKGGPKSVPDRAPVPRGTVLTRTDRSALLWASGNAPSAALSGALFFQGSKSIPRPLNIIRHAGSGPLEVAA LETLALTKMDWNNDALYDPVPVTIRYSQRLARTIANVPDLPGHAYPYRLFM |
| 32 | LSIKSEEDQGLQIADGVPLQFESPLDQAESVPFPPPAEVFQRPTFSFDPSGSRNDNWTQRQLDKTGPYDRATFERKRPRIAVICEAR RRGAMAETVAHFLEGLPEVQSHKGFVPHATGLLGRFRLQKPQVEFFEAKDDSADAYAEAARNALSAAATRDQPWDLALVQVQRSWK DRPATSSPYWWAKAAFLRRDVPVQALSAEMMAMGDFEYACALANVSLATYAKLGGTPWLLKARPSTDHELVFGLGSHTHKERRRGA GERVVGITTVFSSQGNYLLDARTAAVPFDRYPEALRATLIEAVKRIRQEEAWRAGDTVRLVFHAFTQMRQETADAVVAAVESMGLS GVKFAFLHVAEDHPFTLFDHASATGKGAYAPERGQAVELSDHEWLLSLTGRDQIRAASQGIPDPVLLRLHEKSTFRDMRTLTRQVS DFACHSWRTYERARLPITLLYADEIAKQLAGLERTPGWDPDTAVVGAVMRRPWFL |
| 33 | MLEFRYGQRMVYPRDGLFLFGPGDGGRAPINFGVIGTPAGVARFRQWMGSVGNVIDAANDDPQHVPFPGYGAAFASAWPDKPRHII DSIDPAAVSRALRLENRNEAIKSTVDLYVDPLVAAADRLEAPPNFWFVVIPEEIYKLGRPQSSVPKADRIRGSVKLSKSAARDLML EPTFFPEDLEAAEIYQYATHFRRQLKARLLRDRIVTQIVRETTLAPNDFLNKIGKPLRRLEDPATIAWKILTGAYYKDGGRPWQLA DVRPGVCYVGLAYKRQDNSSDDRFACCAAQMFLSSGEGVVFRGALGPWFHSESKQFHLSEDAASSLVEMVIGEYQQMHDGQPPAEL FIHAKSSFADPEWKGFKAAAPGTNVVGVQISDAKDRMKLYRPGRYPVIRGTALILHERRAFLWTSGFAPRLDTYQGPETPNPIEVR IHRGDCELETVLGDVMGLTKINFNSCLHNDRLPVTIRFADAVGDVILAAPRTGEPKLPFKYYI |
| 34 | MLEFRYGQRMVYPRDGLFLFGPGDGGRAPINFGVIGTPAGVARFRQWMGSVGNVIDAANDDPQHVPFPGYGAAFASAWPDKPRHII DSIDPAAVSRALRLENRNEAIKSTVDLYVDPLVAAADRLEAPPNFWFVVIPEEIYKLGRPQSSVPKADRIRGSVKLSKSAARDLML EPTFFPEDLEAAEIYQYATHFRRQLKARLLRDRIVTQIVRETTLAPNDFLNKIGKPLRRLEDPATIAWKILTGAYYKDGGRPWQLA DVRPGVCYVGLAYKRQDNSSDDRFACCAAQMFLSSGEGVVFRGALGPWFHSESKQFHLSEDAASSLVEMVIGEYQQMHDGQPPAEL FIHAKSSFADPEWKGFKAAAPGTNVVGVQISDAKDRMKLYRPGRYPVIRGTALILHERRAFLWTSGFAPRLDTYQGPETPNPIEVR IHRGDCELETVLGDVMGLTKINFNSCLHNDRLPVTIRFADAVGDVILAAPRTGEPKLPFKYYI |
| 35 | LHLNYLPLRFTADIFKGGALTFPEGSEKNWTSDDPISKELSKLREKHGDSHVFHRMGNKIACIPVVENAIAIGTETDFNIISDFQL ANALARSALHRYFKAAGRETVIGFRPVTLLLEKHNLASNRKDVFGIFPEYTLDVRPLAPHEGDIASGVLIGFGIKYVFLQNVAELQ AQGVSAAGMYAVRLVDESEHQFDRAYLGRIDRFTKDNVTLVDSDYAEYPADQCYFEGSRTNIEAVGRSLLGKDYDAFSSSLLQESY KVTGAPNQTQRLHQLGAWLEAKSPIPCAVGLGVRIAKKPHECSRGNDAGYSRFFDSPKCVLRPGGSLTVPWPVDKQIDLNGPYDAE SFPNKRVRIAVICPQEFTGDAEEFLRKLKEGLPNAPDGSPFRKGFVRKYHLSSCDFTFHEVKRSSNSDDIYKDASLEALKQKPDMA IAIIRSQYRGLPDASNPYYTTKARLMAQGVPVQLLNIETIRRKSLDYILNNIGLAMYAKLGGIPWTLTQNSDMAHEIIVGIGSARL NESRRGAGERVIGITTVFSGDGQYLLANNTQEVPSEEYVDALTQSLSETVSELRSRFGWRPKDRVRFIFHQKFKKYKDAEAEAVDR FARSLKDFDVQYAFVHVSDSHNWMLLDPASRGVKFGDTMKGVAVPQRGQCVPLGPNAALLTLSGPFQVKTPLQGCPHPVLVSIHEK STFKSVDYIARQIFNLSFISWRGFNPSTLPVSISYSDMIVDLLGHLRRVKNWNPETLSTALKERRWFL |
| 36 | MKADYIQEPFLLFGKGKSICPREGIAELNVYDTVIEARKNQLLIGIIGIEEDVENLKSWIKRFESYIPADPKGKQKGLFKSFPGFH QDKGFCAKFIYDSNYERILSPNDIKRILKEPDRNKKVLDAVELFGENIGFLSDIKNCDVIICIIPKSFEGKIVKENKDDEPVEQVA EDNEGPELELNFRRALKARAMKYNTPIQLLREYVMHDSNKSQDNATKAWNFCTALYYKGLQTIPWKLEVDENKPKVCFVGIGFYKS RDKKTIQTSLAQIFNENGKGVILRGTPVTEDKDDKKPHLTYEQSLSLLKDALTKYKFATGSMPGRVVLHKTSKYYEDELDGFIQAM QDLGITEYDIVTIMETDLRFFRNNLYPPVRGAVFSLTEQRHILYTRGSVHQYQTYPGMYIPAPLEVRIVSSVSSIRTVCKEILGLT KMNWNNTQFDNKYPITIGCARRVGEIMKYVGENEYPKESYAYYM |
| 37 | MKDLVWVQESSSVKVLRDGNYPVMRGTFVELDGKGLLYTNGSIPYYGTYPGQYDPRPFLLCPHKSSDSTVAQIAKDVLSMTKINWN STQMNQKLPIPIRAARKVGEVLKYVSDGKVSSDYTRYM |
| 38 | MDLSKKSLKTIHIEEPELSFGHGQTCDHPKDGLFLYGPHSGPTRTREVSVGVIGTKDGLSYFRTWAIAAGGFVPVPPRKKTDKENR LHLSNFPGLEEAFGIMVSPGDFVQRTVDYTVLDDATRTVNQHEAVRKAVDLYVGEIERYDNNEEKTVDVWMFILPEIIFERCKPLS RRTGLGLTKGEFAKSQKERIDLPLFKDVIDQSGEDIFDDVPDFHRQVKARLLKLGRTSQLIRETTLAPDKFLNNAGYPKRGLQDPA TVAWNLATGLYYKTQPLPPWKLAHVRPGVCYIGLVFKMIPNDPKEHACCAAQMFLNESDAVVFRGANGPWKTDDFEFHLQPKEAQS LIAKVLKTFEEKHGVPPKEFFIHGCTTFNEDEWKAFKKATPKGTNLVGVRIKETKGESKLFRDGDYPVMRGTAIILDHRNALLWTN GFVPRLDTYIGPETPNPLLITVLRSTGRRPNIRTVLADIMGLTKINYNACNYNDGLPVTIRFASKVGDVLTMGSARDADKQPLKFY V |

TABLE 3

Corresponding Argonaute full genomic nucleic acid sequences identified by PIWI domain as those disclosed in Table 1.

| SEQ ID NO | Sequence |
|---|---|
| 39 | ATGCTCGAGTTTCGCTACGGCCAGCGCATGGTCTATCCACGGGACGGACTATTTCTGTTCGGTCCAGGCGACGGAGGGCGAGCAC<br>CCATCAATTTCGGCGTGATCGGCACTCCCGCGGGAGTCGCTCGCTTCCGGCAGTGGATGGGCTCGGTCGGCAATGTCATAGACGC<br>CGCCAATGACGACCCGCAGCATGTGCCGTTTCCGGGTTATGGTGCCGCCTTCGCCAGTGCTTGGCCAGACAAGCCACGGCACATC<br>ATCGATAGCATCGACCCCGCGGCTGTCTCGCGGGCTCTTCGCCTGGAGAACAGGAACGAGGCGATCAAAAGCACCGTGGATCTGT<br>ATGTCGACCCACTGGTGGCGGCCGCCGATCGCTTGGAGGCACCTCCGAATTTCTGGTTCGTGGTTATTCCTGAGGAAATCTACAA<br>GCTCGGGCGACCCCAATCAAGCGTCCCCAAGGCGGACCGCATCCGCGGTTCGGTGAAACTGTCCAAGTCTGCTGCCAGGGACTTG<br>ATGTTGGAGCCGACGTTCTTCCCCGAAGATCTGGAAGCGGCGGAGATCTATCAATATGCCACCCATTTCAGGCGCCAGTTGAAGG<br>CACGTCTGCTCAGAGACCGTATCGTCACTCAGATCGTTAGGGAAACCACATTGGCGCCTAACGATTTCCTGAACAAAATCGGCAA<br>GCCACTGCGACGATTGGAGGACCCTGCAACGATCGCCTGGAAAATATTGACCGGCGCCTATTACAAGGATGGTGGACGACCATGG<br>CAGTTGGCCGACGTCAGACCCGGCGTTTGCTATGTCGGCCTCGCCTATAAGCGACAGGACAATAGTTCCGATGATCGCTTCGCCT<br>GTTGCGCCGCCCAGATGTTTCTTTCGAGCGGTGAAGGCGTCGTATTTCGCGGTGCGCTCGGCCCATGGTTTCATTCCGAATCCAA<br>GCAATTTCATCTGAGCGAGGACGCGGCAAGCAGTTTAGTTGAGATGGTTATCGGCGAATATCAACAAATGCATGATGGACAGCCG<br>CCCGCTGAGCTGTTCATTCATGCCAAGTCCTCGTTCGCGGACCCGGAATGGAAAGGCTTCAAGGCCGCTGCTCCGGGGACCAATG<br>TCGTAGGAGTGCAGATTTCCGATGCGAAAGACCGCATGAAGCTATACCGGCCGGTCGATATCCGGTCATCCGCGAACGGCCTT<br>GATATTGCACGAACGCCGCGCGTTCCTCTGGACGTCGGGATTCGCCCCGCGCCTTGATACCTCCCAAGGGCCAGAGACGCCGAAT<br>CCGATAGAAGTCCGCATTCACCGCGGAGATTGCGAACTTGAAACGGTTCTCGGGGACGTGATGGGCCTGACCAAGATCAATTTCA<br>ATTCTTGCCTGCATAACGATCGATTGCCGGTGACGATACGTTTCGCCGACGCGGTGGGCGACGTGATCCTCGCGGCACCACGGAC<br>CGGCGAACCGAAGCTGCCGTTCAAGTATTATATATAA |
| 40 | ATGACCAGCCAGCTGCAACATTATGTCCGGCTGCCGGAGCCCAATCTGCTGTTCCATCCGGACCGGCCGAGCGATCGAGACATCC<br>ATCCTCTGCGGGGACTGGCCCGTTTCGGACCCTATTCGAGCATGTTCACCCCGTCCCCATCCGCGTGGCGACGCTTGCGCCTTC<br>CGGGGAATCGCAGCGTCTCTTCGAGTTCCTAAGGGAACTCAACCAGCCTGCGAGACCGCAGGAGCGAACCGACTATCTTCCGGAC<br>TGGGCCAGTTTCAACAGCGTCTTCCAGACGCACCTCGCACCAGCTGCAAGCCATTGTCGGCGGGAACTCGATGCCCAACTGGACG<br>GAGAGTTGAAGGATTGCCCTGCATCGGGTCTGCTGCTTGCCGAACGGCTCATCCGTTCAATCCAGTTGCTCGACGCCAACCGCGC<br>GGATTTTGACGTGCTGTTCATTTATCTTCCTGAACGCTGGTCTCCCGGCTTCTACGGAGCCGATGATTTCGATCTGCATCACCAG<br>CTCAAAGCCTTCACCGCCGCGCGGCAGCTGCCCATTCAGATTGTGCGCGAAGACAGCGCACTATCCTATCGATGCCGGGCCAGCG<br>TCATGTGGCGGATCGGCCTGGCGCTCTACGCCAAGGCTGGCGGCGTTCCTTGGAAACTGGCCGATGTGGAGCCGGACACTGCCTA<br>TATTGGTATCTCCTATGCGCTCCGGCCCGCAGAATCGGAGCTTGCCCGCTTCGTAACCTGTTGCAGCCAGGTCTTCGACGCCGAC<br>GGTGCTGGACTGGAATTCATCGCCTATGACACCGGCGATGTGAACGTACAGCGGGAGAACCCGTTTCTCTCGCATACCGAGATGT<br>TTCGGGTCATCACCCGTTCGCTGGACCTTTATCGCCGGCGCCATGGCGGCAGACTGCCGACACGTGTGATGATCCACAAATCGAC<br>CGAGTTCAAGGAAGCCGAAATAGAAGGCTGCTTCGAAGCGCTGAAACATATCGAGTCGGTCGATCTCATCCAGATCGTCGAGGAC<br>AATGGCTGGCAGGGCGTGCGATGGGAACAGGACCGTAACGATCCGGAGATATCACAAGCGGATGGGTATCCGGTGAAACGCGGAA<br>CCTTGCTCGGGCTCAGCGGCAAAGACGCTTTGCTCTGGATGCACGGGGCAGTCGATGGTTCGGGCGCCGCCCCTATTTTCAAGG<br>TGGCAAAGGTACACCGCGACCGTTGCGACTGGTCCGACATGCCGGGCATGGAACATGGGACGATACCGCGAAGGCGGCCCTGGCG<br>CTGTCGAAAATGAACTGGAACAATGACGGGCTCTATGATCCACTTCCGGTGACGATGAGCTACGCAAAGACCTTAGCACAGGTGA<br>TCAAGCGGATGCCGGGGCTCGGCAAGGGCACTTACCAGTTCCGATTTTTCATGTGA |
| 41 | ATGCTCGAGTTTCGCTACGGCCAGCGCATGGTCTATCCACGGGACGGACTATTTCTGTTCGGTCCAGGCGACGGAGGGCGAGCAC<br>CCATCAATTTCGGCGTGATCGGCACTCCCGCGGGAGTCGCTCGCTTCCGGCAGTGGATGGGCTCGGTCGGCAATGTCATAGACGC<br>CGCCAATGACGACCCGCAGCATGTGCCGTTTCCGGGTTATGGTGCCGCCTTCGCCAGTGCTTGGCCAGACAAGCCACGGCACATC<br>ATCGATAGCATCGACCCCGCGGCTGTCTCGCGGGCTCTTCGCCTGGAGAACAGGAACGAGGCGATCAAAAGCACCGTGGATCTGT<br>ATGTCGACCCACTGGTGGCGGCCGCCGATCGCTTGGAGGCACCTCCGAATTTCTGGTTCGTGGTTATTCCTGAGGAAATCTACAA<br>GCTCGGGCGACCCCAATCAAGCGTCCCCAAGGCGGACCGCATCCGCGGTTCGGTGAAACTGTCCAAGTCTGCTGCCAGGGACTTG<br>ATGTTGGAGCCGACGTTCTTCCCCGAAGATCTGGAAGCGGCGGAGATCTATCAATATGCCACCCATTTCAGGCGCCAGTTGAAGG<br>CACGTCTGCTCAGAGACCGTATCGTCACTCAGATCGTTAGGGAAACCACATTGGCGCCTAACGATTTCCTGAACAAAATCGGCAA<br>GCCACTGCGACGATTGGAGGACCCTGCAACGATCGCCTGGAAAATATTGACCGGCGCCTATTACAAGGATGGTGGACGACCATGG<br>CAGTTGGCCGACGTCAGACCCGGCGTTTGCTATGTCGGCCTCGCCTATAAGCGACAGGACAATAGTTCCGATGATCGCTTCGCCT<br>GTTGCGCCGCCCAGATGTTTCTTTCGAGCGGTGAAGGCGTCGTATTTCGCGGTGCGCTCGGCCCATGGTTTCATTCCGAATCCAA<br>GCAATTTCATCTGAGCGAGGACGCGGCAAGCAGTTTAGTTGAGATGGTTATCGGCGAATATCAACAAATGCATGATGGACAGCCG<br>CCCGCTGAGCTGTTCATTCATGCCAAGTCCTCGTTCGCGGACCCGGAATGGAAAGGCTTCAAGGCCGCTGCTCCGGGGACCAATG<br>TCGTAGGAGTGCAGATTTCCGATGCGAAAGACCGCATGAAGCTATACCGGCCGGTCGATATCCGGTCATCCGCGAACGGCCTT<br>GATATTGCACGAACGCCGCGCGTTCCTCTGGACGTCGGGATTCGCCCCGCGCCTTGATACCTACCAAGGGCCAGAGACGCCGAAT<br>CCGATAGAAGTCCGCATTCACCGCGGAGATTGCGAACTTGAAACGGTTCTCGGGGACGTGATGGGCCTGACCAAGATCAATTTCA<br>ATTCTTGCCTGCATAACGATCGATTGCCGGTGACGATACGTTTCGCCGACGCGGTGGGCGACGTGATCCTCGCGGCACCACGGAC<br>CGGCGAACCGAAGCTGCCGTTCAAGTATTATATATAA |
| 42 | ATGACCCTCGACTTTGACTCTCGCCAGCCCTGGGCACCGCACACGATTCTTCAGGAACCGATGCTGAAGTTTGACAGCAGCCCGA<br>CCCCGGCAACCGCGGGTCACCCGCTCGTCGGACTGCTCGACCACGGCCCCTACGCCGACCGCCGACCGCTAGCGTGCGACTCGC<br>CACGATCACCCTCAACGGTGACAAGCCGAAGCTCTACGACTTCCTCCGCGGTGCCACCCAGGCACACGAACCCAGCGACCGTCTG<br>GCATACGTGCCGCGATATCCGGGGTTCGAGGCGCTGTTCAAGGCCGAGCTTCTTCCTCAGTCCGACGCCCACGTCGACATCCGGA<br>GCGCCGAGATCGGCACCGGTGCTGACGCGCACGACCGACTCAGCGAGGCGCTTGCCCGTGCGGTGCGGCACCTCCACACCGTTCG<br>CGACTCCTGGGACGTCATCGTCTTCCTACTCCCTGCAGCCTGGGAGCCTCTGAGGCTCAGCGCCGACGGTGCGCTGGACCTGCAC<br>GACCGGTTGAAGGCGACGGCCGCGCTGCTGGGCTGTCCTATCCAGATGATCCGCGAGACCTCCGCGCTGCAGTTCAGGTACAAGT<br>GCTCCATGTACTGGCGGCTGTCGATTGCGCTGCTGACGAAGGCTGGCGGCGTGCCGTTCCGGATGATGCGTCCCACTGAGTCCGA<br>CACTGCCTACCTCGGGCTGGCCTACGCGATTCGCGGCGGGACCGCCAACGAGTTCGTCACCTGCTGCTCGCAGGTCTTCGACGCC<br>GAAGGCGGCGGCTTCGAATTTATCGCCTACAACGTCGGCGCCGACCGTGACCTGGAGAACCCGCATCTGACCCGCGACAGGATGC<br>GCACCGTCATGGCGCGCAGCGCTCGCCTCTACCAGCGGCGCAGGGCCGGGTCTCTGCCCCAGCGGCTTTGTGATCCACAAGACGAC<br>AACCTGGCGTGAGGAAGAAGTCGCAGGGGTCTTCGACGCGTGGAGCCCGGCCGTTCCTGACATCGAGTGCCTCCAGGTACGTCTA<br>GACACACCCTGGACCGGGGTTGCCCTCCGCGGCGGCAAGGGCAACTCGGCGGTCGCCAACGAATGGCCTGTGGGCGCGGGTCTC<br>TTCAGTATCTCTCTGGGCGGGAGGCACTCCTGTGGATCGCCGGTACGGCGAAGGGTGTCGCGCTGACGGGTGAGAACTATAATCA<br>GGCAGCCAAGGCTCTACCGACCCCGATTGCGTTCAAGCGTGACGCGGGTGCTGGCCCCCTGGAGATTCCTGCCAGCGAAATCCTT<br>GCCCTGTCGAAGCTCGACTGGAACAACGACGCCCTTTACGGTGTGACCCCGTGA |

TABLE 3-continued

Corresponding Argonaute full genomic nucleic acid sequences identified by PIWI domain as those disclosed in Table 1.

| SEQ ID NO | Sequence |
|---|---|
| 43 | GTGGAAATGGTTTTCGAGCAAGTGCTTCTCCGCGGCCACATTGGCGTCGTCGAAGAAGACGCCTTGGCGCTGTACCGCTATTTGG<br>AGAAGAAGCCTATATCGCCCTGCGGTGCCAGGATCTGA |
| 44 | TTGACGGGGGCGGTCTTCGCAGCCGCGGCGTTCGATGCCTTCGCCGGTATGAGGGAACATCTGCGCGCCACAGCACGCCTCCTTC<br>GCTTCGACCGGGTTGTTTGTACGCTTGAAGACGAGGCCTGTGTAGCAGACGCCATCCCGGATGTCGGCAAGAGACCACGGCTTCT<br>CGCCCGCTTTGTAATAGACACCAGTCGTGAGATTCCACGCGACGGTGCGTCATCCTGCATCTTGCGGGAAAGCTCGCCCTTGCTG<br>TTGAGGTATTCGCGCGGGGCAATGGCGGTCTGCGCACGAGCTGGGTGA |
| 45 | ATGACGACTAGGCCGCGATCCTTCAAGCCTCAGATGCTCTATCTGGAAGAACCTCAGCTTGAGTTCCGCCACGGTCAGCACCTCG<br>TCTATCCCCGCGACGGCCTCTACCTCTATGGACCCGTCGGCGAGACAAAAGAACTGCCGACGATCCGATACGGCGTGATTGGCAC<br>GCCGGATGGCGTAGGTCGCTTCAAAGCCTGGGCACAATCCATGGCAGGATTTATAGATATCCCACCGCCTGGGCGCGTTCGCGC<br>GCTGTCGAACCACAGCATGTTCCATTTCCGGGCTTCGCCGCGGCTTTCCATGCTGACTGGCCCGTTGAACCGCCCTACATCATTG<br>ACAGCCTTGATCCCGACGAGATCGAACAAAGCTCAGGATCGCCAATCGTCATGAGGCGGTGCGCAACACTGTCGACATGTTCGT<br>GTCGCGCCTCGTCGCTGAGAACAATCGCCTCGAAAGCGACCGGAAATTCTTGGTTCGTCGTCATTCCCGAAAAGGTCTACGAACTC<br>GGCAGACCGAAATCGACGGTTAGACGTGACGATCGCGTTGCGGGCGAAGTGACGATCTCCCAGCGTCGTGCAAAGGAGCTGCAGC<br>GCCAACCGACCTTGTTTGGCGAGGACGAGCGCGAAGCCGAAGTCTATCAATATGCGACCCATTTCCGCCGGCAACTAAAGGCACG<br>GCTCCTCAAAGAGCGGATTGTCACGCAGATCGTTCGTGAAACGACGCTGGCGCCCGGCGATTTCCGTCGCGAGAGCGGCATGCCG<br>ATCAGACGCGTCGAGGATCCTGCGACTATCGCCTGGAAAATGGGAACGGGCGCCTACTACAAGGCTGGCGGGAAGCCTTGGCAGT<br>TGGCCGATGTTCGACCGGGCGTCTGTTATGTCGGACTGGTCTACAAACGCAGCGAACTAACAAGCGACAAGCGTCATGCCTGCTG<br>CGCAGCCCAAATGTTTCTCGCTGACGGGGAAGGCGTGGTCTTCCGCGGCGCGCTCGGCCCTTGGTTCCAAACCGATACGAAGCAG<br>TTCCACCTTGATAAGGATGCCGCCAGGAACCTTATCAAGATGGTGGTGGGCGAATACACCCGCCTGCACGATGGCCCACCAACCG<br>AACTCTTCATCCACGCGAAGTCCGCCTTTTACCGACAACGAATGGCGCGGTTTTTCGTCCGCCTGCGGGGATGAGACCAACCTCGT<br>CGGTGTGCAGATTGCCGAGGCTCGTGATGACCTGAAGCTCTATCGTCCTGGAGAGTATCCCGTCATTCGCGGCACGGCGCTGCAG<br>ATCGGTGAACGTCACGCACTTCTGTGGACCTCGGGCTATGTGCCACGGCTGGACACCTATATGGGGCTGAGACCCCGAACCCGA<br>TTTCGGTTCGCGTTCTTCGCGGCGAGTGCCCACTGACGACGGTCCTCGCCGACGTGCTCGGGCTCACGAAGATCAACTTCAATTC<br>GTGCCTTCACAATGACCGGTTACCGGTGACGATCCGTTTCGCCAACGCGGTCGGAGATGTCCTCATTTCCGCCCCGATGGATGGC<br>GAGCCGAAGCTGCCGTTCAAATTCTACATCTAG |
| 46 | ATGGCATCCCTGCAAGGATCGCATCAGCCAAGCGATCGCCTCGAGTATGTGCCGCCTTACCCCGGCTTTGAATCTTTGTTTGGCA<br>TCGCGTTGCAGTCCGCACCAGCCGAAGCTCACGTGAAATGGCCGGACGCTATTCGCGATCTTCCCGGCGAAGGGAATGATCAGGT<br>TCGCCTATTCTTAGCGATGGACGCAGCGTTGCGACGTCTTGACGATGCGAAATGAGTTTGACGTCGTTCTTTTCCATTTTCCA<br>GATAGCTGGGACGCGACTACGAACCAAGTTTTTCGATGCTCACGACACACTCAAGGCATTGGGCGCGAAATATAATATACCAA<br>CGCAGGTGCTCAATGACCGTGTCTTTCGTTTTCACACCCTGCGTCGCGATCCTGGCGGCTGGCGATAGCGCTTTATGTTAAGGC<br>AGCGGGCACACCTTGGAAGCTTGCGCCCCTGAAAGGTGTACCTGAGGACACGGCTTACATCGGCCTCGCCTACGCCTTACGGGGC<br>GACCAGCGGGATGCGCACTATGTGACGTGCTGTTCCCAGGTGTTTGATATGGATGGCGGAGGAATGCAGTTCGTTGCCTTCGAGG<br>CCAAGGATCCTATCGCCGATGTCGCAGAAGCGCGTCGAAATCCATTTCTCAGTCGAGATGATATGCGCGCGGTTCTTGCTCGCAG<br>CCTCGAGCTCTATCAAGGAAGAAATGGAGGAACACTGCCGAAGCGGCTTGTCATTCATAAGACCACAGCATTCAAACCGGATGAG<br>ATCGAGGGTGCGTTTGATGCACTTGCCGGGGTGCAAGAAATCGAGTGCATTGAAGTTAGCCCAGCTTCCGGTTGGCGTGGGGTAT<br>GGCTGGTACCGAGCGGCAGCCGAAGCCGCCGACCAAGCCTGCAGGCTACCCTGTTCCGAGAGGCACCGTTGTCGTCCGGTCCGG<br>GACCTCGGCGCTTGTTTGGGTCGCGGGCAATGCTCCCGAAGTGTCTAATAAGGGCGACTATTATCAGGGAAAGAAGAGCATTCCA<br>AAGCCGTTGCAGCTGATCAGGCACGCAGGCAGTGGACCGTTGGAGCTATCGGCTCACGAGGCCTTGGCTCTCACCAAGATGGATT<br>GGAACAATGATGCTCTCTACGATCCTGTGCCTGTTAGCATCCGATACTCGCAACGCTTAGCCAAGACGATCGCGAACGTCCCAGA<br>TTTGCCCAGAACGTCTATCCATATCGGCTCTTCATGTGA |
| 47 | GTGGACGCCCTCGTTCGGTCGCTGGCCGTGTCCCAAGACCGTCCCTTGATGCTTTTCCTTGGCGCGGGCGCATCGATGACTTCCG<br>GGATGCCTTCCGCTAACCAATGCATCTGGGAATGGAAGCGGGATATTTTTCTTTCGAATAATCCAGGTATCGAGGAGCAGTTTAG<br>CGAACTTTCCCTCCCTTCCGTTCGCGACAGAATTCAAACATGGTTGACAGGCAACGGTGCTATCCGGTCGCCGGGCATCCTGAC<br>GAATACGGTGCCTACATTGAAGCGTCGTTTCTCGCGCAGTGACGATCGTCGTCGCTATTTTGAAAGATGGGTCAAACAGTCTACGC<br>CTCACACCGGTTATAGGCTGCTAGCCGAACTCGCCGCTTCCGGTTTGATTCAGACCGTGTGGACGACAAATTTCGACGGACTCAT<br>CGCGCGTGCTGCAGTTGCCACGAATCTGACATCCATCGAAATTGGAATAGATTCCCAGCAACGACTTTACCGCGCGCCGGGTAAA<br>GACGAACTGGCTTGCGTCTCGATGCACGGCGATTACCGATATGATCGCCTCAAAAATTCGCCAGGAGAACTCGCCCAGGTCGAAG<br>TCCAGCTTCGTGACTCGCTCATTGAGGCCTTAAGAACGCATACCGTCGTTGTTGCTGGATACAGCGGTCGCGACGAGAGTGTGAT<br>GCAGGCATTCCGCCAATATGCGGCATCAGGTCCCGCGCGAACAGATTTGCCGCTGTTCTGGACGCAATACGGCGAGGACCCGCCT<br>TTGGACACGGTCAGCGCCTTCCTCTCGACGAACGACGACGAGCCATCCCGCTTCATCGTTCCGGGCGTTTCCTTCGACGATCTCA<br>TGCCGCGGTTGGCGCTCTACCTGTCAAAGGGGCCGGCCAGAGACCGCGTCAATAAAATCCTCGACGAGCATGCGACAACGCCCGT<br>TAACCAGCTCACTGCTTTCGGGCTCCCCCCTCTTCCCCCGACCGGCCTCATCAAAAGCAACGCAATTCCGCTGACACCGCCGCAG<br>GAGCTTCTTGAGTTTGATTTGCATCAATGGCCGGCTTCCGGAACCGTGTGGGCCACGTTGAGGGAGCTTGGCGACAAACACAATT<br>TTGTCGCCGCGCCGTTCCGATCGAAGATTTATGCGATCGCTATAGCCGAAAGTCTTCGCCTCGCCTTCGGCGAGAATCTGAAAGG<br>GGAAATCAAACGGGTTCCCCTGAACGATGACGATCTGCGATACGAAGACGGCGTCATCAACCAGCTTGTCCGCGTGCGACCGTC<br>CTCGCCTTATCGGCCAAGGCAAATTGCCCGTCAGACGGAGAGTCGTTGACTCTGACATCCGAGAAGGTCGAGAATTTGCGCCTGG<br>ACAGGGTCGACTGGAAAGTTCACCAGGCCGTACTGGTCCAGATACGCCCGCTCGGAACCGAGATGGCGCTCGTCCTGAAGCCCAC<br>CCTGTACGTTACCGACAAGAGCGGAGCGATCGCACCCAAGGATACTGAGCGGCTCGTCAAGCAGCGCGTGCTGGGCTATCAGCAC<br>AACAAGGAATTCAACGACGCAACCGAAGCGTGGCGACGTCGCCTCGTGCCTCAGCGCGATTTTCATGTCCGCTTCCCTGACCATG<br>AAGACGGTATCGATCTGACTTTCTCTGGACGACCGCGTCGTTTGCGCGAATCACTGACGAGCGCGAGCGTACCGTTTCACTCAGTTC<br>CGCTCAGGAGTTAGCCGCGAGGCAAGCCGGACTTCAACTCGCAGAACCACGACTGAAATTCGCGCGCAAATCGGCAGCCGGACTG<br>GCATTCGACACCCATCCTGTCCGAGGCCTGATCAACAACAGGCCGTTCGATTCCAGCCTCACCACGACAGGCATAGCTTCCTCCA<br>TCCGCGTCGGAATCATTGCGCCTGCCCAGGACGCCACACGAGTTCACCAGTACCTGTCCCAGCTTCACGTCGCCGCACAGCCAGG<br>GAAGGACGCGGATTATCTCCCGCGTTTCCAGGTTTCGCGTCCGCCTACCAGTGCCCGCTCAGTGCCCGGTCGGTTGTGAACAA<br>TCTTTCGTCCAGCTTGACGAGCCGGACAGCATGACACCCTCGTCAGCACGCGCTTTGGCCGGAGCAATCACGAGGTCGATTGCCT<br>CCTTGAGCGCGTCGCAGCGTCCCGACGTAACATCATTTACGTCCCCGATCGCTGGGCTCCGTTGCGCAACTACATGATCGACGA<br>TGAAGAGTTCGATCTACACGATTTCGTCAAGGCGGCGGCGATTCCGAAAGGTTGCGCCACACAGTTTGTCGAAGAGGACACCCTC<br>CGTAACACGCAGCAGCAATGCCGCGTGCGCTGGTGGCTCTCGCTTGCCCTGTACGTGAAAAGCATGCGCACGCGTGGACTTTGG<br>AAGGCCTCAGCGAGAAATCCGCCTACGTGGGTCTCGGCTTCAGCGTCAAACGCAAGACGACACAGAATGCGGGCGCACACGTCGT |

TABLE 3-continued

Corresponding Argonaute full genomic nucleic acid sequences identified by PIWI domain as those disclosed in Table 1.

| SEQ ID NO | Sequence |
|---|---|
| | GCTGGGCTGTAGCCACCTCTATAGCCCGAACGGCATCGGTCTGCAGTTCCGCCTGAGCAAGATCGAAGATCCAATTATGCGCAAC<br>AAGAATCCCTTCATGAGCTTCGACGATGCAAGACGGCTCGGTGAGGGCATCCGTGAACTGTTTTTCGCCGCCCAACTTCGACTTC<br>CTGAGCGAGTGGTGATCCACAAGCAGACCCCATTCCTTCGCGAAGAACGCAGTGGGCTCCAGGCTGGACTCGAGGGAGTTGCGTG<br>CGTAGAGCTATTGCAGATCTTCGTTGACGACACGCTACGGTATGTGGCGTCCCATCCGACCTCCGACGGAAAGTTCGAGACCGAC<br>AACTATCCCATCCGGCGGGGAACGACAGTGGTCATCGACGATCACACGGCTCTTCTGTGGGTCCACGGCGCATCTACTGCACTAA<br>ATCCCAGAAGGCACTATTTCCAGGGCAAGCGTCCAGCCCCCTTGGTAATTCGGCGTCATGCGGGCACGACCGATTTGAT<br>GACGATCGCCGACGAAGTTCTCGGCTTGTCGAAGATGAATTTCAACAGCTTCGACCTTTACGGGCAACTTCCAGCGACGATCGAG<br>ACGTCACGCCGCGTTGCGAAGATCGGCGCACTTCTCGATCGCTTCTCGGAACACTCGTACGATTACCGTCTGTTTATGTAG |
| 48 | ATGAGCGTGGACGCCATGATTCGGTCCATCGGGGTTGCGCGAGATCGGCCACTGCTGGTGTTCTTGGGTGCTGGAGCTTCCATGA<br>GTTCCGGCATGCCATCGGCCACACAGTGCATCTGGGAATGGAAGCGGGAAATATTCCTGACCAACAACCCCGACGTCGAGAAGAC<br>CCAGTTCAGCGAGTTGTCCCTGCCGTCAGTAAGGCTCCGGATTCAAGCCTGGCTGGATCGCCAGCGCCGCTATCCGGCACTGGAT<br>CATCCTGACGAATACAGCACCTACATCGGCGAGTGTTTCGCAAGAAGCGACGACCGCCGAATCTACTTCGAGAATGGGTGAAGA<br>GATGTTCGCCGCATCTCGGCTATCAACTGCTGGCGGAACTCGCGCGGCAAGGTTTGGTGGCATCGGTCTGGACAACCAACTTCGA<br>TGCCTTGGCCGCTCGCGCCGCGACCTCCATCAATCTGACCGCCATCGAGATCGGCATCGATAGCCAGCAGCGTCTGTATCGGGCG<br>CCTGGAGAGGCCGAACTCGCCTGCGTCACTCCACGGCGACTATCGATACGATCCGTTGAAGAACACGGCCCCGAACTCATCA<br>AGCAGGAGAAGAACTGCGCGAGTCACTGGTGCAGGCATGCGAACTCACACCGTTCTCGTATGCGGCTACAGCGGGCGCGATGA<br>AAGCGTCATGGCGGCCTTTTCGGACGCCTACGATGCGGCGCATTTCAAAGGCATCACCCGCTGTTCTGGACGCAGTATGGCGAC<br>TACCCAGCATCGGAGCCGGTCGCCGGACTCCTTGCATCGCCCCTCGATCAGGAACCGGCGAAGTTCCACGTGCCCGGACTTCGT<br>TCGACGATCTGATGCGACGTATTGCACTGCATGTGTCGGACGGCGAGGCACGCGAGCGTGTGCGCAAAATTCTGGAAAATTTCAA<br>GACAGCGCCGGTCAACCAGAAGTTGCCCTTTGCCCTGCCGTCATTGCCCGTCACCGGTCTGGTCAAAAGCAACGCCATTCCGCTC<br>ATTCCGCCGGGCGAGTTGATCGAGTTCGATCTGGTGCGGTGGCCGCCGTCAGGTGAAGTCTGGTCGACCTTGAGAGAGATTGGGG<br>ATCGACATGGCTTCGTGGCTGCACCCTTCAGAGGCAAGGTCTACGCGCTGGCCACCATCGAGCAGTTGACCCAGGCGTTCGCTGA<br>CAACGTGAAGGATGGCGCGTTCAATCGGGTGCCGCTGAACAATGACGATCTCCGCTACGAGGATGGCACCGCCAACCAACTGATG<br>CGCAGAGCGACTGTGCTTGCCTTGGCCGGGAAGGCTGGCTGCGCTAACGATGGCGACGCCATTGTCTGGGACACGTCGCGATCCA<br>AAACGGAGCGCCTGGACCGTCAATTGTGGACGGTGTACGACGCCGTCCTGCTTCAGATTAGGCCTCTTGGGACGAAGCTCGCGCT<br>GGTGCTCAAGCCCACACTCCGAGTCACTGACAGCACTGGTGAAGTTGCACCGAAGGAGATCGAACGCGCGGTCAAGGTCCGCGTG<br>CTCGGGTACCAGCACAACAAGGAGTTCAACCAGGCGACGGACTTCTGGCGAAAGCGCTTACTGCCATGCGTGACCTGCTAGTCC<br>GCTTCCCCGATCTCGACGGCGGCATGACCTTCACCATCTCCGGCCGCCCGATCTTCGCGCGACTCACGGACGAGCGAACCGAGAC<br>CGTCACGCTGAATGATGCGCAGGAGCGCTCGGCCTCTCAAGTTGGCCTGCAACTCGCCGAGCCCAAGCTGGTATTTGCCCGAACC<br>GTCGGCACTGGGCTGCAACGGACACGCTTCCCGTTCGCGGTCTTTTGCAGAATCGGCCGTTCGATGCCAATCTGACCGACCTCG<br>GCATTGCCACAAATCTGCGAATCGCGGTGATCGCGCCCGCCCGCGATGCGCGCGTGTCCACGACTACTTGGGCCAGCTTCATCA<br>GCCCATCGATCCCACGAAATGGGACGCTGACTACTTGATGAGGTTCCCGGGCTTCAGCAGCGCATTTAAATGCCCGCTGGACATT<br>CCACAACCAGGTCAGGCCGCCTTCGTCACGTTGGATGAGCCGCATGACGAATCGCCGCAATCTGCGCGCACGCTCGCAGGCCGCA<br>TCACCGCGGCCCTCTCCGCATTGCGGGCCACGGAAAAACCCAAGCGTCACCATCATCTACATACCCGCCAGATGGCATGCCCTTCG<br>AGCGTTCGACCTTGAGAGCGAACAGTTCAACCTTCACGATTTTGTGAAGGCCGGATCATCCCGGCTGGTTGCTCCACTCAGTTT<br>CTCGAAGAAAGCACTCTCGCCAACGGTCAGCAATGCCGCGTTCGATGGTGGTTGTCTGGCTGTGTACGTGAAAGCCATGCGCA<br>CCCCCTGGGCCCTCACCGGCCTTGATAGGGATTCCGCCTTCGTGGGCCTCGGCTTCAGCGTCCGCCGAAAGATCGACGGCGAAGG<br>CCATGTCGCGCTGGGCTGCAGCCACCTCTACAGCCCCAATGGTCACGGCCTTCAATTCCGCCTGAGCAAGATCGACAACCCGATC<br>ATGCTGCGCAAGAACCCCTTCATGAGCTTCGACGACGCGCGAAAGCTTTGGGGAAGGCATCCGAGAGCTGTTCTTCGACGCCCACC<br>TACGCCTTCCCAATCGCGTCGTGGTGCACAAGCAAACGCCTTTCCTGAAGGAGGAGCGCGAGGGGCTGCAAGCTGGCCTGGAGGG<br>CGTGGCCTGCGTCGAGTTGTTGCAGATCTTCGTCGATGACACCTTGCGGTACGTGGCATCGCGCCCGATGCCAATGGCGACTTC<br>GAGATTCACGGCTATCCGATTCGACGCGGCACAACGGTTGTAGTGGACGATCAGACAGCATTGCTGTGGGTGCACGGAACCTCTA<br>CCGCTCTCAACCCTAGGCAATCCTACTTTCAGGGGAAGCGCCGAATTCCGGCCCCGCTCGTGATGCGCCGCCACGCCGGCACTAG<br>CGATCTCATGATGCTGGCCGATGAAATCCTTGGCCTGTCCAAGATGAACTTCAACAGCTTTGATCTCTATGGGCAGTTGCCCGCA<br>ACCATCGAAACCTCTCAACGGGTCGCGCGCATCGGTGCCCTGCTTGATCGGTACACCGAGCGTTCGTATGACTACAGGCTTTTCA<br>TGTGA |
| 49 | ATGCTCGAGTTTCGCTACGGCCAGCGCATGGTCTATCCACGGGACGGACTATTTCTGTTCGGTCCAGGCGACGGAGGGCGAGCAC<br>CCATCAATTTCGGCGTGATCGGCACTCCCGCGGGAGTCGCTCGCTTCCGGCAGTGGATGGGCTCGGTCGGCAATGTCATAGACGC<br>CGCCAATGACGACCCGCAGCATGTGCCGTTTCCGGGTTATGGTGCCGCCTTCGCCAGTGCTTGGCCAGACAAGCCACGGCACATC<br>ATCGATAGCATCGACCCCCGCGGCTGTCTCGCGGGCTCTTCGCCTGGAGAACAGGAACGAGGCGATCAAAAGCACCGTGGATCTGT<br>ATGTCGACCCACTGGTGGCGGCCGCCGATCGCTTGGAGGCACCTCCGAATTTCTGGTTCGTGGTTATTCCTGAGGAAATCTACAA<br>GCTCGGGCGACCCCAATCAAGCGTCCCCAAGGCGGACCGCATCCGCGGTTCGGTGAAACTGTCCAAGTCTGCTGCCAGGGACTTG<br>ATGTTGGAGCCGACGTTCTTCCCCGAAGATCTGGAAGCGGCGGAGATCTATCAATATGCCACCCATTTCAGGCGCCAGTTGAAGG<br>CACGTCTGCTCAGAGACCGTATCGTCACTCAGATCGTTAGGGAAACCACATTGGCGCCTAACGATTTCCTGAACAAAATCGGCAA<br>GCCACTGCGACGATTGGAGGACCCTGCAACGATCGCCTGGAAAATATTGACCGGCGTCCTATTACAAGGATGGTGGACGACCATGG<br>CAGTTGGCCGACGTCAGACCCGGCGTTTGCTATGTCGGCCTCGCCTATAAGCGACAGGACAATAGTTCCGATGATCGCTTCGCCT<br>GTTGCGCCGCCCAGATGTTTCTTTCGAGCGGTGAAGGCGTCGTATTTCGCGGTGCGCTCGGCCCATGGTTTCATTCCGAATCCAA<br>GCAATTTCATCTGAGCGAGGACGCGGCAAGCAGTTTAGTTGAGATGGTTATCGGCGAATATCAACAAATGCATGATGGACAGCCG<br>CCCGCTGAGCTGTTCATTCATGCCACCAAGTCCTCGTTCGCGGACCCGGAATGGAAAGGCTTCAAGGCCGCTGCTCCGGGGACCAATG<br>TCGTAGGAGTGCAGATTTCCGATGCGAAAGACCGCATGAAGCTATACCGGCCCGGTCGATATCCGGTCATCCGCGGAACGGCCTT<br>GATATTGCACGAACGCCGCGTTCCTCTGGACGTCGGGATTCGCCCCGCGCCTTGATACCTACCAAGGGCCAGAGACGCCGAAT<br>CCGATAGAAGTCCGCATTCACCGCGGAGATTGCGAACTTGAAACGGTTCTCGGGGACGTGATGGGCCTGACCAAGATCAATTTCA<br>ATTCTTGCCTGCATAACGATCGATTGCCGGTGACGATACGTTTCGCCGACGCGGTGGGCGACGTGATCCTCGCGGCACCACGGAC<br>CGGCGAACCGAAGCTGCCGTTCAAGTATTATATATAA |
| 50 | ATGGACTACAACCTTTCGAAGGCGCCATCGTTTTCCTTGCTGGACGAGCCGGCCCTCACGTTTAACAGCGAAGACACAGACCTCG<br>ACAGAGAACCCGCTGCGCGGCCTTTTCGGTGCCTACAACGGCAAGACGTTCGAGGGCTACACCCCGAAGCTTCGTGTCGC<br>GACAATCGCCCCTGCATCAGGTTGGCCGAAGCTCAAAGGCTTGGTGGACACGATCCGATCAGGTCACGAGGCGAGCGACCGGCGC<br>AACTACGTGCCGTCGTTCCCCGGATTTGAAAACCTGTTTCGCGTTCCGCTCGTCGCGGGGCCGAAGGACGTGCACATTAAGTGGC<br>CCGACGATCTCATGGCCCTGGCGCGTACTGGGGCGCCCCATGAGCGGTTGTTTTCGGCGATGTCGGAAGCCATGGCGCGTCTCGA<br>TGCGTTGCACGATCAGTTTGATGTCGTCTTGGTACATCTCCCTGATGCGTGGGCAACGGCATTCACGGCCAACGGATTCGACGCC<br>CACGACGCGTTGAAGGCCCTTGGAGCCCGGTACGCCATCCCAACGCAGGTCATCAACGATCGCGTTTTCACATTCCGGCTCAAGG |

TABLE 3-continued

Corresponding Argonaute full genomic nucleic acid sequences identified by PIWI domain as those disclosed in Table 1.

| SEQ ID NO | Sequence |
|---|---|
| | CGTCGTTGGCCTGGCGCCTGGCCATCGCGCTCTTCACCAAGGCGGGCGGCATTCCCTGGAAACTCGCGCCGATGGTCGGTGTACC<br>AGAAGACACGGCCTATATCGGTCTCGCCTACGCGTTGCGCGGGGACCCCAAGTCCGCGCAGTTCGTCACGTGCTGCTCGCAGGTG<br>TTCGACGCGGACGGCGGTGGCATGCAGTTCGTCGCTTTCGAGGCCAAGGAGCAGGTGGCGGATCCGCGCGAAGCCAGACGGAACC<br>CGTTTCTCAGTCGGAGCGACATGCGGGCGGTAATGGCACGTAGCCTGAGCCTCTACCTTGGGCGTAATGGTGGACGGCTGCCGCG<br>ACGTCTCGTCGTCCACAAAACGACGTCGTTCAAGGACGAAGAACTCCAAGGCGTTTTCGACGGCCTGTCGACGGTTCCAGAGGTG<br>GAGTGCATCGAGATCGGCAGCAGCGCCACATGGCGTGGCGTGTGGCTGAAGCAGGGAAAGAAGGGCGGACCCAAAAGTGTGCCTG<br>ATCGAGCGCCGGTGCCGCGGGGAACTGTCCTCACGCGAACGGACCGGTCGGCGCTGTTGTGGGCATCGGGCAATGCCCCGTCGGC<br>AGCGCTCAGCGGTGCCTTGTTTTTCCAGGGAAGCAAGAGCATTCCGCGCCCGCTCAACATCATCCGTCACGCGGGCAGCGGTCCG<br>CTGGAAGTTGCTGCGTTGGAAACCCTCGCGCTGACCAAAATGGACTGGAACAACGACGCGTTGTACGACCCGGTTCCGGTGACCA<br>TTCGCTATTCGCAACGGCTCGCACGTACCATCGCGAATGTGCCAGATCTTCCGGGGCATGCGTACCCCTATCGCCTCTTCATGTG<br>A |
| 51 | TTGTCCATCAAATCAGAGGAAGATCAGGGCCTTCAGATCGCCGATGGTGTGCCTCTCCAGTTTGAGAGTCCACTTGACCAAGCGG<br>AGTCAGTGCCATTTCCGCCAGCTGAGGTGTTCCAACGGCCCACGTTCTCGTTCGACCCAAGCGGCTCTCGCAATGACAACTGGAC<br>TCAGAGGCAGCTCGATAAGACCGGGCCCTACGATAGAGCCGATTTTGAACGAAAGCGGCCAGGATTGCTGTCATCTGCGAGGCA<br>CGCCGGCGCGGTGCCATGGCAGAGACGGTCGCGCACTTCCTTGAGGGTCTCCCCGAAGTTCAATCTCACAAAGGCTTTGTACCCC<br>ATGCGACGGGGCTGCTGGGCCGCTTCCGGCTTCAGAAGCCGCAAGTTGAATTCTTCGAGGCCAAGGATGACAGCGCTGACGCCTA<br>CGCTGAAGCCGCCCGTAACGCTCTGTCTGCGGCCGCCACTCGGGACCAGCCATGGGATCTAGCCCTGGTGCAGGTCCAGCGATCC<br>TGGAAGGATCGTCCTGCCACCAGTAGCCCTTACTGGTGGGCGAAGGCTGCGTTCCTGCGGCGCGACGTGCCAGTGCAGGCACTCT<br>CCGCCGAGATGATGGCCATGGGCGACTTCGAGTACGCCTGCGCTTTGGCAAACGTCAGCTTGGCCACTTACGCCAAGCTCGGCGG<br>TACCCCTTGGCTGCTGAAGGCCCGGCCCTCGACAGATCACGAGCTTGTCTTTGGCCTCGGATCTCATACCCACAAGGAGCGACGT<br>CGAGGTGCAGGGGAACGGGTCGTCGGGATCACGACCGTGTTCTCTAGCCAGGGTAACTATCTACTAGATGCCCGAACGGCTGCAG<br>TACCGTTCGACCGCTACCCGGAGGCACTGCGCGCCACGCTCATCGAGGCGGTCAAGCGCATACGGCAAGAGGAGGCCTGGCGCGC<br>GGGCGACACGGTGCGCTTGGTCTTCCATGCCTTCACCCAGATGCGACAAGAGACTGCGGATGCCGTGGTTGCCGCTGTGGAAAGC<br>ATGGGCCTGAGTGGGGTGAAGTTCGCCTTCCTCCATGTGGCCGAGGACCACCCATTCACGCTGTTCGACCACGCCTCAGCGACTG<br>GCAAGGGTGCCTATGCGCCCGAGCGTGGGCAGGCCGTAGAACTCAGCGACCACGAGTGGCTCCTTTCCCTCACCGGACGGGATCA<br>GATCAGAGCCGCGTCGCAGGGCATCCCTGATCCGGTGCTACTCCGCCTGCACGAGAAATCGACCTTTCGCGACATGCGAACGCTG<br>ACGCGTCAGGTATCGGATTTCGCCTGCCACTCCTGCGTACTTACGAACGAGCTAGGCTCCCGATCACACTCCTCTACGCCGACG<br>AAATTGCGAAGCAACTCGCAGGCCTCGAGCGTACCCCGGGATGGGACCCCGATACCGCAGTAGTTGGCGCGGTGATGCGCAGGCC<br>TTGGTTCTTGTGA |
| 52 | ATGCTCGAGTTTCGCTACGGCCAGCGCATGGTCTATCCACGGGACGGACTATTTCTGTTCGGTCCAGGCGACGGAGGGCGAGCAC<br>CCATCAATTTCGGCGTGATCGGCACTCCCGCGGGAGTCGCTCGCTTCCGGCAGTGGATGGGCTCGGTCGGCAATGTCATAGACGC<br>CGCCAATGACGACCCGCAGCATGTGCCGTTTCCGGGTTATGGTGCCGCCTTCGCCAGTGCTTGGCCAGACAAGCCACGGCACATC<br>ATCGATAGCATCGACCCCGCGGCTGTCTCGCGGGCTCTTCGCCTGGAGAACAGGAACGAGGCGATCAAAAGCACCGTGGATCTGT<br>ATGTCGACCCACTGGTGGCGGCCGCCGATCGCTTGGAGGCACCTCCGAATTTCTGGTTCGTGGTTATTCCTGAGGAAATCTACAA<br>GCTCGGGCGACCCCAATCAAGCGTCCCCAAGGCGGACCGCATCCGCGGTTCGGTGAAACTGTCCAAGTCTGCTGCCAGGGACTTG<br>ATGTTGGAGCCGACGTTCTTCCCCGAAGATCTGGAAGCGGCGGAGATCTATCAATATGCCACCCATTTCAGGCGCCAGTTGAAGG<br>CACGTCTGCTCAGAGACCGTATCGTCACTCAGATCGTTAGGGAAACCACATTGGCGCCTAACGATTTCCTGAACAAAATCGGCAA<br>GCCACTGCGACGATTGGAGGACCCTGCAACGATCGCCTGGAAAATATTGACCGGCGCCTATTACAAGGATGGTGGACGACCATGG<br>CAGTTGGCCGACGTCAGACCCGGCGTTTGCTATGTCGGCCTCGCCTATAAGCGACAGGACAATAGTTCCGATGATCGCTTCGCCT<br>GTTGCGCCGCCCAGATGTTTCTTTCGAGCGGTGAAGGCGTCGTATTTCGCGGTGCGCTCGGCCCATGGTTTCATTCCGAATCCAA<br>GCAATTTCATCTGAGCGAGGACGCGGCAAGCAGTTTAGTTGAGATGGTTATCGGCGAATATCAACAAATGCATGATGGACAGCCG<br>CCCGCTGAGCTGTTCATTCATGCCAAGTCCTCGTTCGCGGACCCGGAATGGAAAGGCTTCAAGGCCGCTGCTCCGGGGACCAATG<br>TCGTAGGAGTGCAGATTTCCGATGCGAAAGACCGCATGAAGCTATACCGGCCCGGTCGATATCCGGTCATCCGCGAACGGCCTT<br>GATATTGCACGAACGCCGCGCGTTCCTCTGGACGTCGGGATTCGCCCCGCGCCTTGATACCTACCAAGGGCCAGAGACGCCGAAT<br>CCGATAGAAGTCCGCATTCACCGCGGAGATTGCGAACTTGAAACGGTTCTCGGGGACGTGATGGGCCTGACCAAGATCAATTTCA<br>ATTCTTGCCTGCATAACGATCGATTGCCGGTGACGATACGTTTCGCCGACGCGGTGGGCGACGTGATCCTCGCGGCACCACGGAC<br>CGGCGAACCGAAGCTGCCGTTCAAGTATTATATATAA |
| 53 | ATGCTCGAGTTTCGCTACGGCCAGCGCATGGTCTATCCACGGGACGGACTATTTCTGTTCGGTCCAGGCGACGGAGGGCGAGCAC<br>CCATCAATTTCGGCGTGATCGGCACTCCCGCGGGAGTCGCTCGCTTCCGGCAGTGGATGGGCTCGGTCGGCAATGTCATAGACGC<br>CGCCAATGACGACCCGCAGCATGTGCCGTTTCCGGGTTATGGTGCCGCCTTCGCCAGTGCTTGGCCAGACAAGCCACGGCACATC<br>ATCGATAGCATCGACCCCGCGGCTGTCTCGCGGGCTCTTCGCCTGGAGAACAGGAACGAGGCGATCAAAAGCACCGTGGATCTGT<br>ATGTCGACCCACTGGTGGCGGCCGCCGATCGCTTGGAGGCACCTCCGAATTTCTGGTTCGTGGTTATTCCTGAGGAAATCTACAA<br>GCTCGGGCGACCCCAATCAAGCGTCCCCAAGGCGGACCGCATCCGCGGTTCGGTGAAACTGTCCAAGTCTGCTGCCAGGGACTTG<br>ATGTTGGAGCCGACGTTCTTCCCCGAAGATCTGGAAGCGGCGGAGATCTATCAATATGCCACCCATTTCAGGCGCCAGTTGAAGG<br>CACGTCTGCTCAGAGACCGTATCGTCACTCAGATCGTTAGGGAAACCACATTGGCGCCTAACGATTTCCTGAACAAAATCGGCAA<br>GCCACTGCGACGATTGGAGGACCCTGCAACGATCGCCTGGAAAATATTGACCGGCGCCTATTACAAGGATGGTGGACGACCATGG<br>CAGTTGGCCGACGTCAGACCCGGCGTTTGCTATGTCGGCCTCGCCTATAAGCGACAGGACAATAGTTCCGATGATCGCTTCGCCT<br>GTTGCGCCGCCCAGATGTTTCTTTCGAGCGGTGAAGGCGTCGTATTTCGCGGTGCGCTCGGCCCATGGTTTCATTCCGAATCCAA<br>GCAATTTCATCTGAGCGAGGACGCGGCAAGCAGTTTAGTTGAGATGGTTATCGGCGAATATCAACAAATGCATGATGGACAGCCG<br>CCCGCTGAGCTGTTCATTCATGCCAAGTCCTCGTTCGCGGACCCGGAATGGAAAGGCTTCAAGGCCGCTGCTCCGGGGACCAATG<br>TCGTAGGAGTGCAGATTTCCGATGCGAAAGACCGCATGAAGCTATACCGGCCCGGTCGATATCCGGTCATCCGCGAACGGCCTT<br>GATATTGCACGAACGCCGCGCGTTCCTCTGGACGTCGGGATTCGCCCCGCGCCTTGATACCTACCAAGGGCCAGAGACGCCGAAT<br>CCGATAGAAGTCCGCATTCACCGCGGAGATTGCGAACTTGAAACGGTTCTCGGGGACGTGATGGGCCTGACCAAGATCAATTTCA<br>ATTCTTGCCTGCATAACGATCGATTGCCGGTGACGATACGTTTCGCCGACGCGGTGGGCGACGTGATCCTCGCGGCACCACGGAC<br>CGGCGAACCGAAGCTGCCGTTCAAGTATTATATATAA |
| 54 | TTGCATCTCAACTACCTGCCGCTACGTTTTACTGCCGACATATTCAAAGGGGCGCTCTGACCTTTCCTGAAGGTTCAGAAAAAA<br>ACTGGACCTCCGACGACCCAATCAGCAAAGAGTTGAGCAAGTTGAGAGAGAAGCATGGGGATTCCCATGTTTTTCATCGAATGGG<br>AAATAAAATCGCCTGCATCCCGGTAGTAGAAAACGCGATCGCAATTGGCACTGAAACAGACTTCAACATCATCTCCGACTTTCAG<br>TTAGCGAATGCGCTCGCACGCTCAGCATTACATAGATATTTCAAAGCTGCTGGCAGAGAGACTGTTATCGGCTTTCGCCCTGTCA<br>CGCTCCTACTCGAAAAACATAATCTCGCTTCTAACCGCAAAGACGTATTTGGCATTTTCCCCGAATACACGCTCGACGTTAGGCC |

TABLE 3-continued

Corresponding Argonaute full genomic nucleic acid sequences identified by PIWI domain as those disclosed in Table 1.

| SEQ ID NO | Sequence |
|---|---|
| | GTTAGCTCCGCACGAGGGGGACATCGCGAGCGGAGTTCTTATTGGATTTGGAATCAAATACGTCTTCCTCCAGAATGTCGCTGAA<br>CTTCAGGCTCAGGGTGTTTCAGCAGCCGGCATGTACGCCGTGCGGTTAGTTGACGAGTCCGAACATCAGTTTGATCGGGCCTACC<br>TCGGACGGATCGACCGCTTCACAAAGGACAACGTAACCCTAGTCGATTCTGACTATGCGGAGTATCCAGCCGATCAGTGCTATTT<br>CGAAGGTAGTCGTACAAATATCGAGGCAGTCGGCCGAAGCCTCCTTGGCAAAGACTACGATGCCTTTTCGAGCTCGCTTCTTCAG<br>GAAAGCTACAAAGTGACCGGCGCTCCCAATCAGACCCAGCGACTCCATCAACTTGGAGCCTGGTTGGAAGCAAAATCCCCAATTC<br>CGTGCGCCGTCGGCTTAGGAGTGCGGATCGCTAAGAAACCCCATGAGTGTTCACGAGGCAATGATGCCGGCTACTCCAGATTTTT<br>CGACTCTCCCAAATGTGTCCTTCGCCCTGGAGGTTCGTTAACCGTTCCTTGGCCTGTCGACAAGCAAATCGACCTCAATGGTCCT<br>TACGACGCAGAGTCATTTCCAAACAAACGGGTGCGCATCGCCGTCATCTGTCCGCAAGAGTTCACCGGGGATGCCGAAGAGTTTT<br>TGAGAAAGCTGAAGGAGGGGCTACCCAACGCTCCTGATGGATCGCCTTTCGGGAAAGGTTTCGTCCGCAAATACCACTTGAGCAG<br>TTGCGATTTTACGTTCCACGAAGTGAAGCGCAGTTCGAATTCCGACGACATTTACAAGGATGCTTCGTTGGAGGCGTTGAAACAG<br>AAGCCAGACATGGCAATCGCAATCATCCGTTCGCAGTATCGAGGGCTTCCCGATGCGTCGAACCCGTACTACACCACTAAAGCGC<br>GATTGATGGCGCAAGGTGTTCCAGTACAACTATTGAATATCGAAACCATCCGTCGAAAAAGCCTTGACTACATTCTCAATAATAT<br>CGGGCTTGCTATGTACGCGAAGCTTGGCGGAATCCCTTGGACGCTGACCCAGAACAGCGATATGGCGCACGAGATTATCGTTGGT<br>ATAGGAAGCGCCAGATTGAACGAAAGCCGTCGTGGTGCAGGCGAGCGGGTGATCGGAATTACGACCGTTTTCAGCGGCGATGGCC<br>AGTACCTGTTGGCAAACAATACTCAAGAGGTGCCTTCAGAAGAGTACGTTGATGCTCTGACTCAGTCTCTCTCGGAGACTGTGAG<br>TGAACTCAGGAGCCGATTCGGTTGGAGACCAAAAGACAGGGTCCGATTCATCTTCCATCAAAAGTTCAAGAAGTACAAAGATGCT<br>GAAGCTGAGGCAGTTGATCGCTTCGCACGATCACTCAAAGATTTCGACGTGCAATATGCCTTCGTTCATGTCAGTGACTCGCACA<br>ACTGGATGTTGCTAGATCCCGCATCGAGGGGAGTGAAGTTCGGCGACACAATGAAGGGAGTGGCGGTCCCGCAGAGGGGACAATG<br>TGTGCCTCTAGGGCCAAACGCTGCTCTTTTGACTTTGTCCGGGCCATTTCAGGTCAAGACGCCACTGCAAGGTTGCCCTCATCCA<br>GTACTGGTGAGCATTCACGAGAAGTCCACGTTCAAGAGCGTGGATTATATCGCTCGCCAAATTTTCAATCTCAGCTTCATCTCAT<br>GGAGGGGTTTCAACCCGTCAACGCTTCCAGTTTCGATTTCTTACTCAGACATGATCGTAGATCTGTTGGGGCATTTGAGAAGGGT<br>TAAGAACTGGAATCCCGAGACGCTTTCGACCGCACTGAAAGAAAGGCGCTGGTTCCTATGA |
| 55 | ATGAAAGCGGACTACATACAAGAACCTTTTTTATTATTTGGCAAAGGCAAAAGTATTTGTCCTAGAGAAGGTATTGCCGAATTAA<br>ATGTATATGACACGGTAATTGAAGCCAGAAAAAATCAATTGCTCATTGGCATAATTGGGATTGAAGAAGATGTAGAAAATCTGAA<br>AAGTTGGATAAAAAGGTTTGAAAGCTATATTCCTGCAGATCCCAAAGGCAAACAGAAAGGATTGTTCAAATCGTTTCCGGGATTC<br>CATCAGGACAAAGGGTTCTGTGCAAAATTCATTTACGATTCAAATTATGAGAGGATTCTCTCACCAAATGACATTAAAAGGATTT<br>TGAAAGAACCTGATAGGAATAAGAAAGTATTGGATGCAGTAGAGTTGTTTGGTGAAAACATTGGCTTTCTCTCTGATATTAAAAA<br>CTGCGACGTAATAATATGGATCATACCGAAAAGCTTTGAAGGTAAAATAGTAAAAGAGAACAAAGATGATGAACCAGTTGAACAA<br>GTGGCTGAAGATAACGAAGGACCTGAATTGGAACTGAATTTTAGAAGAGCATTAAAAGCCCGTGCAATGAAATACAACACACCTA<br>TTCAGTTGTTGAGAGAATATGTAATGCACGACAGTAACAAATCACAAGATAATGCAACTAAGGCATGGAATTTTTGCACTGCTCT<br>TTATTATAAGGGACTTCAAACCATTCCTTGGAAGTTGGAAGTAGACGGAACAAACCAAAAGTATGTTTTGTAGGTATTGGATTC<br>TACAAAAGCAGGGACAAGAAAACGATTCAAACCAGTTTAGCACAAATTTTCAATGAAAATGGAAAAGGTGTGATACTTCGCGGAA<br>CTCCTGTAACTGAAGATAAAGACGATAAAAAACCTCACTTAACTTATGAGCAATCTTTAAGCCTTCTGAAAGATGCCTTGACCAA<br>ATACAAGTTTGCGACAGGTTCAATGCCAGGTAGAGTAGTTTTACACAAGACTTCAAAATACTATGAGGATGAACTTGACGGCTTT<br>ATTCAAGCAATGCAGGATTTGGGTATAACTGAATACGATATTGTAACTATCATGGAAACCGATTTTGCGTTTCTTTAGAAATAATC<br>TTTATCCACCAGTGAGAGGGGCAGTTTTTTCATTGACTGAACAAAGACACATACTTTACACTAGGGGTTCAGTTCATCAATATCA<br>GACATATCCAGGAATGTATATTCCTGCTCCATTAGAAGTAAGAATAGTAAGTTCCGTTTCATCTATAAGGACAGTTTGTAAAGAA<br>ATTCTTGGCTTGACAAAAATGAATTGGAACAACACCCAATTCGACAACAAATACCCCATTACAATTGGCTGTGCAAGACGGGTAG<br>GAGAAATAATGAAATACGTTGGAGAAAATGAATATCCGAAAGAATCTTATGCATATTATATGTGA |
| 56 | ATGAAGGACCTTGTATGGGTCCAGGAATCCTCGTCGGTGAAAGTCCTCCGCGACGGGAACTATCCCGTGATGCGCGGCACCTTTG<br>TCGAACTCGACGGGAAAGGGCTTCTCTATACGAACGGCAGCATCCCGTACTACGGAACCTATCCAGGCCAGTATGATCCCAGGCC<br>ATTTCTGCTATGTCCGCACAAAAGCAGCGACAGCACCGTCGCGCAGATCGCCAAAGACGTGCTGTCGATGACGAAGATCAACTGG<br>AATTCGACCCAGATGAACCAGAAGCTGCCCATTCCCATCCGGGCCGCACGAAAGGTTGGTGAGGTTCTTAAATACGTCAGCGATG<br>GAAAGGTCAGTTCCGACTACACCCGATATATGTGA |
| 57 | ATGGACCTGTCGAAGAAATCCCTCAAGACTATCCACATTGAGGAACCGGAGTTGTCTTTCGGCCACGGGCAAACTTGCGACCACC<br>CGAAAGATGGACTGTTTCTCTACGGGCCGCACTCTGGCCCAACACGCACGCGCGAAGTTTCCGTTGGAGTCATTGGAACGAAAGA<br>CGGACTCTCGTATTTTCGGACGTGGGCGATTGCGGCTGGCGGCTTTGTTCCCGTCCCGCCGCGAAAGAAAACCGACAAAGAAAAC<br>AGATTGCACCTCTCGAATTTTCCTGGGTTGGAAGAAGCGTTTGGCATCATGGTCAGCCCGGGAGACTTTGTTCAGCGTACTGTCG<br>ATTACACGGTACTCGACGACGCCACCCGTACGGTGAACCAGCATGAAGCGGTACGCAAAGCGGTGGACCTCTATGTGGGAGAAAT<br>TGAACGCTATGACAACAATGAAGAAAAGACGGTAGACGTTTGGATGTTCATTCTCCCCGAAATCATCTTCGAGCGTTGCAAGCCG<br>CTATCGCGGCGCACCGGCCTTGGCCTGACAAAAGGCGAATTCGCCAAGAGCCAGAAAGAAAGAATTGATCTTCCGTTGTTCAAGG<br>ATGTGATCGACCAGAGCGGCGAGGACATCTTTGACGACGTGCCAGATTTTCACCGCCAGGTGAAAGCGCGTCTGCTCAAGCTAGG<br>TCGCACTTCGCAACTCATCCGCGAAACGACGTTGGCACCCGACAAATTCCTAAATAACGCGGGCTATCCAAAGCGTGGGTTGCAG<br>GATCCGGCGACAGTGGCGTGGAATCTGGCAACTGGACTTTACTACAAAACCCAACCCTTGCCGCCGTGGAAACTCGCGCATGTCA<br>GGCCGGGCGTTTGTTACATCGGACTTGTTTTCAAGATGATTCCGAATGATCCAAAGGAACATGCCTGCTGTGCGGCGCAGATGTT<br>TCTTAATGAGAGCGACGCCGTTGTTTTCAGGGGCGCAAATGGCCCGTGGAAAACCGACGACTTTGAATTCCACCTTCAACCCAAA<br>GAGGCGCAAAGCCTGATTGCCAAAGTGCTCAAAAACCTTCGAGGAGAAGCACGGTGTGCCACCAAAGGAATTTTTCATCCACGGGT<br>GCACAACCTTCAACGAGGATGAATGGAAAGCCTTCAAAAAGGCCACGCCGAAGGGCACCAACTCTTGTCGGCGTCCGCATCAAGGA<br>AACCAAAGGGGAATCCAAGCTGTTCCGTGATGGTGATTATCCGGTAATGAGGGGAACGGCCATCATTCTTGATCACCGAAACGCC<br>TTGCTGTGGACGAATGGATTTGTGCCACGGCTGGACACCTATATTGGGCCTGAGACGCCAAACCCGCTTTTGATAACCGTTCTGC<br>GTAGTACGGGTCGGCGACCTAACATTCGCACCGTTCTTGCTGACATCATGGGCCTTACCAAGATCAACTACAACGCCTGCAACTA<br>CAATGACGGATTGCCCGTCACGATCCGCTTTGCGAGCAAGGTGGGCGATGTGCTGACGATGGGTTCGGCACGCGACGCAGACAAA<br>CAGCCCCTGAAGTTCTACGTCTAG |

In some cases, a nuclease can be from one or more CRISPR systems, or a variant or derivative thereof. A nuclease from a CRISPR system can be a Cas protein.

In S. pyogenes, Cas9 can generate a blunt-ended double-stranded break from about 1 bp to about 10 bp upstream of the protospacer-adjacent motif (PAM) via a process mediated by two catalytic domains in the protein: an HNH domain that cleaves the complementary strand of the DNA and a RuvC-like domain that cleaves the non-complementary strand. In some cases, the double-stranded break is at about 3 bp upstream of the PAM. See Jinke et al., Science 337, 816-821 (2012) hereby incorporated by reference in its entirety. Cas9 proteins are known to exist in many Type II CRISPR systems including the following as identified in the supplementary information to Makarova et al., Nature Reviews, Microbiology, Vol. 9, June 2011, pp. 467-477: *Methanococcus maripaludis* C7; *Corynebacterium diphtheriae*; *Corynebacterium efficiens* YS-314; *Corynebacterium glutamicum* ATCC 13032 Kitasato; *Corynebacterium glutamicum* ATCC 13032 Bielefeld; *Corynebacterium glutamicum* R; *Corynebacterium kroppenstedtii* DSM 44385; *Mycobacterium abscessus* ATCC 19977; *Nocardia farcinica* IFM10152; *Rhodococcus erythropolis* PR4; *Rhodococcus jostii* RHA1; *Rhodococcus opacus* B4 uid36573; *Acidothermus cellulolyticus* 11B; *Arthrobacter chlorophenolicus* A6; *Kribbella flavida* DSM 17836 uid43465; *Thermomonospora curvata* DSM 43183; *Bifidobacterium dentium* Bd1; *Bifidobacterium longum* DJO10A; *Slackia heliotrinireducens* DSM 20476; *Persephonella marina* EX H1; *Bacteroides fragilis* NCTC 9434; *Capnocytophaga ochracea* DSM 7271; *Flavobacterium psychrophilum* JIP02 86; *Akkermansia muciniphila* ATCC BAA 835; *Roseiflexus castenholzii* DSM 13941; *Roseiflexus* RS1; *Synechocystis* PCC6803; *Elusimicrobium minutum* Pei191; uncultured Termite group 1 bacterium phylotype Rs D17; *Fibrobacter succinogenes* S85; *Bacillus cereus* ATCC 10987; *Listeria innocua*; *Lactobacillus casei*; *Lactobacillus rhamnosus* GG; *Lactobacillus salivarius* UCC118; *Streptococcus agalactiae* A909; *Streptococcus agalactiae* NEM316; *Streptococcus agalactiae* 2603; *Streptococcus dysgalacfiae equisimilis* GGS 124; *Streptococcus equi zooepidemicus* MGCS10565; *Streptococcus gallolyficus* UCN34 uid46061; *Streptococcus gordonii* Challis subst CH1; *Streptococcus mutans* NN2025 uid46353; *Streptococcus mutans*; *Streptococcus pyogenes* M1 GAS; *Streptococcus pyogenes* MGAS5005; *Streptococcus pyogenes* MGAS2096; *Streptococcus pyogenes* MGAS9429; *Streptococcus pyogenes* MGAS10270; *Streptococcus pyogenes* MGAS6180; *Streptococcus pyogenes* MGAS315; *Streptococcus pyogenes* SSI-1; *Streptococcus pyogenes* MGAS10750; *Streptococcus pyogenes* NZ131; *Streptococcus thermophiles* CNRZ1066; *Streptococcus thermophiles* LMD-9; *Streptococcus thermophiles* LMG 18311; *Clostridium botulinum* A3 Loch Maree; *Clostridium botulinum* B Eklund 17B; *Clostridium botulinum* Ba4 657; *Clostridium botulinum* F Langeland; *Clostridium cellulolyticum* H10; *Finegoldia magna* ATCC 29328; *Eubacterium rectale* ATCC 33656; *Mycoplasma gallisepficum*; *Mycoplasma* mobile 163K; *Mycoplasma penetrans*; *Mycoplasma synoviae* 53; *Streptobacillus moniliformis* DSM 12112; *Bradyrhizobium* BTAil; *Nitrobacter hamburgensis* X14; *Rhodopseudomonas palustris* BisB 18; *Rhodopseudomonas palustris* B is B5; *Parvibaculum lavamentivorans* DS-1; *Dinoroseobacter shibae* DFL 12; *Gluconacetobacter diazotrophicus* Pal 5 FAPERJ; *Gluconacetobacter diazotrophicus* Pal 5 JGI; *Azospirillum* B510 uid46085; *Rhodospirillum rubrum* ATCC 11170; *Diaphorobacter* TPSY uid29975; *Verminephrobacter eiseniae* EF01-2; *Neisseria meningitides* 053442; *Neisseria meningitides* alpha 14; *Neisseria meningitides* Z2491; *Desulfovibrio salexigens* DSM 2638; *Campylobacter jejuni* doylei 269 97; *Campylobacter jejuni* 81116; *Campylobacter jejuni*; *Campylobacter lari* RM2100; *Helicobacter hepaticus*; *Wolinella succinogenes*; *Tolumonas auensis* DSM 9187; *Pseudoalteromonas atlantica* T6c; *Shewanella pealeana* ATCC 700345; *Legionella pneumophila* Paris; *Actinobacillus succinogenes* 130Z; *Pasteurella multocida*; *Francisella tularensis novicida* U112; *Francisella tularensis* holarcfica; *Francisella tularensis* FSC 198; *Francisella tularensis tularensis*; *Francisella tularensis* WY96-3418; and *Treponema denticola* ATCC 35405. Accordingly, aspects of the present disclosure are directed to a Cas9 protein present in a Type II CRISPR system that are used in combination with the disclosed gene editing system. In some cases, a Cas can be used as a module in the RNase-H like domain containing peptide complex.

Non-limiting examples of Cas proteins can include Cast, Cas1B, Cas2, Cas3, Cas4, Cas5, Cas6, Cas7, Cas8, Cas9 (also known as Csn1 or Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, xCas9, CasX, CasY, CasRX. homologues thereof, or modified versions thereof. In some cases, alternatives to Cas can be utilized. For example, in some cases, a Cpf1 endonuclease can be used. Cpf1 can be phylogenetically close to bacterial and archaea Argonauts. For example, at a C-terminus of Cpf1 it may align with an Argonaute. A C terminus of Cpf1 can comprise a PIWI domain. In some cases, a catalytically dead Cas protein (e.g., dCas9) may also be used. A Cas can be partially catalytically dead. A Cas protein can have DNA or RNA cleavage activity. A CRISPR enzyme can direct cleavage of one or both strands at a target sequence, such as within a gene sequence and/or within a complement of a gene sequence. For example, a CRISPR enzyme can direct cleavage of one or both strands within or within about 1, 2, 3, 4, 5, 6, 7, 8, 9, 10, 15, 20, 25, 50, 100, 200, 500, or more base pairs from the first or last nucleotide of a protospacer adjacent motif (PAM) sequence. In some cases a Cas protein can be a high fidelity Cas protein such as Cas9HiFi. In some cases, a Cas can be a partially dead Cas such as a nickase.

TABLE 4

*Streptococcus pyogenes* Cas9 (SpCas9)

| SEQ ID NO | Sequence 5' to 3' |
|---|---|
| 58 | ATGGACTATAAGGACCACGACGGAGACTACAAGGATCATGATA TTGATTACAAAGACGATGACGATAAGATGGCCCCAAAGAAGAA GCGGAAGGTCGGTATCCACGGAGTCCCAGCAGCCGACAAGAAG TACAGCATCGGCCTGGACATCGGCACCAACTCTGTGGGCTGGG CCGTGATCACCGACG |

In some cases, a Cas9 can be utilized. A Cas9 can refer to a polypeptide with at least or at least about 50%, 60%, 70%, 80%, 90%, 100% sequence identity and/or sequence similarity to a wild type exemplary Cas9 polypeptide (e.g., Cas9 from *S. pyogenes*). Cas9 can refer to a polypeptide with at most or at most about 50%, 60%, 70%, 80%, 90%, 100% sequence identity and/or sequence similarity to a wild type exemplary Cas9 polypeptide (e.g., from *S. pyogenes*). Cas9 can refer to the wild type or a modified form of the Cas9 protein that can comprise an amino acid change such as a deletion, insertion, substitution, variant, mutation, fusion, chimera, or any combination thereof. Cas9 can refer to a polypeptide with at least or at least about 50%, 60%, 70%, 80%, 90%, 100% sequence identity and/or sequence similarity to SEQ ID NO: 58.

While *S. pyogenes* Cas9 (SpCas9), Table 4, can be used as a CRISPR endonuclease for genome engineering, in some cases it will not be the best endonuclease for every target excision site. For example, the PAM sequence for SpCas9 (5' NGG 3') is abundant throughout the human genome, but a NGG sequence may not be positioned correctly to target a desired gene for modification. In some cases, a different endonuclease can be used to target certain genomic targets. In some cases, synthetic SpCas9-derived variants with non-NGG PAM sequences can be used. Additionally, other Cas9 orthologues from various species have been identified and these "non-SpCas9s" bind a variety of PAM sequences that could also be useful for the present invention. For example, the relatively large size of SpCas9 (approximately 4 kb coding sequence) means that plasmids carrying the SpCas9 cDNA cannot be efficiently expressed in a cell. Conversely, the coding sequence for *Staphylococcus aureus* Cas9 (SaCas9) is approximately 1 kilo base shorter than SpCas9, possibly allowing it to be efficiently expressed in a cell Similar to SpCas9, the SaCas9 endonuclease is capable of modifying target genes in mammalian cells in vitro and in mice in vivo.

Alternatives to *S. pyogenes* Cas9 can include RNA-guided endonucleases from the Cpf1 family that display cleavage activity in mammalian cells. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. In some cases, a nuclease may comprise a polynucleic acid-unwinding agent, such as a helicase. In other cases, a nuclease may not contain a DNA-unwinding agent. A nuclease that can unwind a polynucleic acid can be Cas or Cpf1.

In some cases, a nuclease can function in a transposon/transposase system. Transposable elements can be natural, non-viral gene delivery vehicles capable of mediating stable genomic integration and/or disruption. A transposon/transposase can be PiggyBac. PiggyBac can be made up of both a transposon cassette and a transposase. A PiggyBac system transposon can modify a genome at a 'TTAA' site.

A nuclease can be codon optimized for expression in particular cells, such as eukaryotic cells. A polynucleotide encoding an endonuclease (e.g., an Argonaute) can be codon optimized for expression in particular cells, such as eukaryotic cells. This type of optimization can entail the mutation of foreign-derived (e.g., recombinant) nucleic acids to mimic the codon preferences of the intended host organism or cell while encoding the same protein.

Transposases may be symmetrically coordinated and exchange roles to alternately activate water and a 3'-OH for successive strand cleavage and transfer by a ping-pong mechanism.

In some embodiments, RNase-H specifically recognizes an A form RNA strand and a B form DNA strand.

A nuclease can bind and/or modify (e.g., cleave, methylate, demethylate, etc.) a target nucleic acid and/or a polypeptide associated with target nucleic acid. As described in further detail below, in some cases, a subject nuclease can have enzymatic activity that modifies target nucleic acid. Enzymatic activity may refer to nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity. In other cases, a subject nuclease can have enzymatic activity that modifies a polypeptide associated with a target nucleic acid.

In some embodiments, in addition to or as a substitute for nucleic acid-cleaving activity, the compositions, polypeptides, methods, and systems described herein can also have a "pasting" function. Accordingly, the compositions, polypeptides, methods, and systems can be used to insert a nucleic acid into a target sequence in addition to or instead of cleaving the target nucleic acid. Such exemplary nucleic acid-insertion activities include, but are not limited to, integrase, flippase, transponase, and recombinase activity. Thus, exemplary polypeptides having such function (nucleic acid-insertion polypeptides) include integrases, recombinases, and flippases. These nucleic acid-insertion polypeptides can, for example, insert a nucleic acid sequence at a site that has been cleaved by a polypeptide of the present disclosure.

In some cases, an Argonaute nuclease, CRISPR nuclease, or RNase-H like nuclease can contain a nuclear localization sequence (NLS). A nuclear localization sequence can be from SV40. An NLS can be from at least one of: SV40, nucleoplasmin, importin alpha, C-myc, EGL-13, TUS, BORG, hnRNPA1, Mata2, or PY-NLS. An NLS can be on a C-terminus or an N-terminus of a nuclease polypeptide or nucleic acid. In some cases, a nuclease may contain from about 1 to about 10 NLS sequences. A nuclease can contain 1, 2, 3, 4, 5, 6, 7, 8, 9, or up to 10 NLS sequences. A nuclease may contain a SV40 and nuceloplasmin NLS sequence. In some cases, an NLS can be from Simian Vacuolating Virus 40.

Unwinding Agents

In some cases, a nucleic acid unwinding agent may be utilized. A nucleic acid unwinding agent may be a polynucleic acid, protein, drug, or system that unwinds a nucleic acid. A nucleic acid unwinding agent can be energy. A nucleic acid unwinding agent can provide energy or heat. Unwinding can refer to the unwinding of a double helix (e.g., of DNA) as well as to unwinding a double-stranded nucleic acid to convert it to a single-stranded nucleic acid or to unwinding DNA from histones. In some embodiments, an unwinding agent is a helicase. In some embodiments, helicases are enzymes that bind nucleic acid or nucleic acid protein complexes. In some embodiments, a helicase is a DNA helicase. In some embodiments, a helicase is an RNA helicase. In some embodiments, a helicase unwinds a polynucleic acid at any position. In some cases, a position that is unwound is found within an immune checkpoint gene. In some cases, a position of a nucleic acid that is unwound encodes a gene involved in disease. In some embodiments, an unwinding agent is an ATPase, helicase, synthetic associated helicase, or topoisomerase.

In some embodiments, a nucleic acid unwinding agent functions by breaking hydrogen bonds between nucleotide base pairs in double-stranded DNA or RNA. In some cases, unwinding a nucleic acid (e.g., by breaking a hydrogen bond) requires energy. To break hydrogen bonds, nucleic acid unwinding agents can use energy stored in ATP. In some embodiments, a nucleic acid unwinding agent includes an ATPase. For example, a polypeptide with nucleic acid unwinding activity can comprise or be fused to an ATPase. In some embodiments, an ATPase is added to a cellular system.

In some embodiments, a nucleic acid unwinding agent is a polypeptide. For example, a nucleic acid unwinding peptide can be of prokaryotic origin, archaeal origin, or eukaryotic origin. In some embodiments, a nucleic acid unwinding polypeptide comprises a helicase domain, a topoisomerase domain, a Cas protein domain e.g., a Cas protein domain selected from the group consisting of: Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, xCas9, CasX, CasY, CasRX or a catalytically dead nucleic acid unwinding domain such as a dCas domain (e.g., a dCas9 domain).

In some embodiments, a nucleic acid unwinding agent is a small molecule. For example, a small molecule nucleic acid unwinding agent can unwind a nucleic acid through intercalation, groove binding or covalent binding to the nucleic acid, or a combination thereof. Exemplary small molecule nucleic acid unwinding agents include, but are not limited to, 9-aminoacridine, quinacrine, chloroquine, acriflavin, amsacrine, (Z)-3-(acridin-9-ylamino)-2-(5-chloro-1, 3-benzoxazol-2-yl)prop-2-enal, small molecules that can stabilize quadruplex structures, quarfloxin, quindoline, quinoline-based triazine compounds, BRACO-19, acridines, pyridostatin, and derivatives thereof.

In some embodiments, a polynucleic acid is unwound in a physical manner. A physical manner can include addition of heat or shearing for example. In some cases, a polynucleic acid such as DNA or RNA can be exposed to heat for nucleic acid unwinding. A DNA or RNA may denature at temperatures from about 50° C. to about 150° C. DNA or RNA denatures from about 50° C. to 60° C., from about 60° C. to about 70° C., from about 70° C. to about 80° C., from about 80° C. to about 90° C., from about 90° C. to about 100° C., from about 100° C. to about 110° C., from about 110° C. to about 120° C., from about 120° C. to about 130° C., from about 130° C. to about 140° C., from about 140° C. to about 150° C.

In some cases, a polynucleic acid can be denatured via changes in pH. For example, sodium hydroxide (NaOH) can be used to denature a polynucleic acid by increasing a pH to about 25 to about 29. In some cases, a polynucleic acid can be denatured via the addition of a salt.

In some cases, the disclosed editing system utilizing an unwinding agent can reduce a thermodynamic energetic requirement by about 1%, 2%, 3%, 4%, 5%, 6%, 7%, 8%, 9%, 10%, 15%, 20%, 25%, 40%, 50%, or up to about 60% as compared to a system that does not employ the disclosed unwinding agent. In some cases, the disclosed editing system utilizing an unwinding agent can reduce an immune response to the unwinding agent by about 1%, 2%, 3%, 4%, 5%, 6%, 7%, 8%, 9%, 10%, 15%, 20%, 25%, 40%, 50%, or up to about 60% as compared to a system that does not employ the disclosed unwinding agent. In some cases, an unwinding agent can be harvested from bacteria that are endogenously present in the human body to prevent eliciting an immune response.

Regulatory domain polypeptide (RDP)

In some cases, a regulatory domain polypeptide can be part of a nucleic acid editing system. An RDP can regulate a level of an activity, such as editing, of a nucleic acid editing system. Non-limiting examples of RDPs can include recombinases, epigenetic modulators, germ cell repair domains, or DNA repair proteins. In some cases, an RDP can be mined by screening for co-localized DNA repair proteins in a region comprising an RNase-H like domain containing polypeptide.

Exemplary recombinases that can be used as RDPs include Cre, Hin, Tre, or FLP recombinases. In some cases, recombinases involved in homologous recombination can be utilized. For example an RDP can be RadA, Rad51, RecA, Dmcl, or UvsX.

An epigenetic modulator can be a protein that can modify an epigenome directly through DNA methylation, post-translational modification of chromatin, or by altering a structure of chromatin.

Exemplary germ cell repair domains can include ATM, ATR, or DNA-PK to name a few. A germ cell repair domain can repair DNA damage though a variety of mechanisms such as nucleotide excision repair (NER), base excision repair (BER), mismatch repair (MMR), DNA double strand break repair (DSBR), and post replication repair (PRR).

An RDP can be a tunable component of a nucleic acid editing system. For example, an RDP can be swapped in the editing system to achieve a particular outcome. In some cases, an RDP can be selected based on a cell to be targeted, a level of editing efficiency that is sought, or in order to reduce off-target effects of a nucleic acid editing system. A dialing up or a tuning can enhance a parameter (efficiency, safety, speed, or accuracy) of a genomic break repair by about 5%, 10%, 15%, 20%, 30%, 40%, 50%, 60%, 70%, 80%, 90%, 95%, or up to about 100% as compared to a comparable gene editing system. A dialing down or a tuning can be performed by interchanging a domain such as an RDP to achieve a different effect during a genomic modification. For example, a different effect may be a skewing towards a particular genomic break repair, a recombination, an epigenetic modulation, or a high fidelity repair. In some cases, an RDP may be used to enhance a transgene insertion into a genomic break. In some cases, interchanging a module of a gene editing system can allow for HDR of a double strand break as opposed to NHEJ or MMEJ. Use of a gene editing system disclosed herein can allow for preferential HDR of a double strand break over that of comparable or alternate gene editing systems. In some cases, an HDR repair can preferentially occur in a population of cells from about 5%, 10%, 15%, 20%, 30%, 40%, 50%, 60%, 70%, 80%, 90%, 95%, or up to about 100% over that which occurs in a comparable gene editing system without said RDP.

In some cases, the disclosed editing system utilizing an RDP can reduce a thermodynamic energetic requirement by about 1%, 2%, 3%, 4%, 5%, 6%, 7%, 8%, 9%, 10%, 15%, 20%, 25%, 40%, 50%, or up to about 60% as compared to a system that does not employ the disclosed RDP. In some cases, the disclosed editing system utilizing an RDP can reduce an immune response to the RDP by about 1%, 2%, 3%, 4%, 5%, 6%, 7%, 8%, 9%, 10%, 15%, 20%, 25%, 40%, 50%, or up to about 60% as compared to a system that does not employ the disclosed RDP. In some cases, an RDP can be harvested from bacteria that are endogenously present in the human body to prevent eliciting an immune response.

Guiding Polynucleic Acid

A guiding polynucleic acid can direct a gene editing system comprising an RHDC polypeptide-encoded protein to a genomic location. In some cases, a guiding polynucleic acid can be a DNA. In other cases, a guiding polynucleic acid can be RNA. A guiding polynucleic acid can be a combination of DNA and RNA. A guiding polynucleic acid can be single stranded, double stranded, or a combination thereof. A guiding polynucleic acid can be at least or at least about 5, 10, 15, 16, 17, 18, 19, 20, 21, 22, 23, 24, 25, 30 or more nucleotides long. A guiding polynucleotide can be at most or at most about 5, 10, 15, 16, 17, 18, 19, 20, 21, 22, 23, 24, 25, 30 or more nucleotides long. A guiding polynucleotide can be about 5, 10, 15, 16, 17, 18, 19, 20, 21, 22, 23, 24, 25, 30 or more nucleotides long. In some cases, a guiding polynucleic acid may be truncated, such as in Table 22. Truncated guiding polynucleic acids can be utilized to determine a minimum binding length.

A guiding polynucleic acid can be a guide RNA (i.e., "gRNA") that can associate with and direct an RHDC polypeptide to a specific target sequence within a target nucleic acid by virtue of hybridization to a target site of the target nucleic acid. Similarly a guiding polynucleic acid can be a guide RNA (i.e., "gDNA") that can associate with and direct an RHDC polypeptide to a specific target sequence within a target nucleic acid by virtue of hybridization to a target site of the target nucleic acid. In some cases, a guiding polynucleic acid can hybridize with a mismatch between a guiding polynucleic acid and a target nucleic acid. A guiding polynucleic acid can comprise at least about 1, 2, 3, 4, 5, 6, 7, 8, 9, 10, 11, 12, 13, 14, 15, 16, 18, 19, 20, 25, 30, 35, or up to 40 mismatches when hybridized to a target nucleic acid. In some cases, a guiding polynucleic acid can tolerate mismatches in a recruiting domain, for example at g6, g7, and g8. In some cases, a guiding polynucleic acid can contain mismatches in a stabilization domain. A stabilization domain can be adjacent to a 3' end of a guiding molecule. For example, positions g6-g16, such as g6, g7, g8, g9, g10, g11, g12, g13, g14, g15, and g16 or any combination thereof, can be mismatched in 16 nucleotide long guide molecules. Mismatches in a recruiting domain can have mismatches preferably in positions g6, g7, and/or g8.

A method disclosed herein also can comprise introducing into a cell or embryo at least one guide RNA or nucleic acid, e.g., DNA encoding at least one guide RNA. A guide RNA can interact with a RNA-guided endonuclease to direct the endonuclease to a specific target site, at which site the 5' end of the guide RNA base pairs with a specific protospacer sequence in a chromosomal sequence.

A guide RNA can comprise two RNAs, e.g., CRISPR RNA (crRNA) and transactivating crRNA (tracrRNA). A guide RNA can sometimes comprise a single-guide RNA (sgRNA) formed by fusion of a portion (e.g., a functional portion) of crRNA and tracrRNA. A guide RNA can also be a dual RNA comprising a crRNA and a tracrRNA. A guide RNA can comprise a crRNA and lack a tracrRNA. Furthermore, a crRNA can hybridize with a target DNA or protospacer sequence.

As discussed above, a guide RNA can be an expression product. For example, a DNA that encodes a guide RNA can be a vector comprising a sequence coding for the guide RNA. A guide RNA can be transferred into a cell or organism by transfecting the cell or organism with an isolated guide RNA or plasmid DNA comprising a sequence coding for the guide RNA and a promoter. A guide RNA can also be transferred into a cell or organism in other way, such as using virus-mediated gene delivery.

A guiding polynucleic acid can be isolated. For example, a guide RNA can be transfected in the form of an isolated RNA into a cell or organism. A guide RNA can be prepared by in vitro transcription using any in vitro transcription system. A guide RNA can be transferred to a cell in the form of isolated RNA rather than in the form of plasmid comprising encoding sequence for a guide RNA.

A guide RNA can comprise a DNA-targeting segment and a protein binding segment. A DNA-targeting segment (or DNA-targeting sequence, or spacer sequence) comprises a nucleotide sequence that can be complementary to a specific sequence within a target DNA (e.g., a protospacer). A protein-binding segment (or protein-binding sequence) can interact with a site-directed modifying polypeptide, e.g. an RNA-guided endonuclease such as a Cas protein. By "segment" it is meant a segment/section/region of a molecule, e.g., a contiguous stretch of nucleotides in RNA. A segment can also mean a region/section of a complex such that a segment can comprise regions of more than one molecule. For example, in some cases a protein-binding segment of a DNA-targeting RNA is one RNA molecule and the protein-binding segment therefore comprises a region of that RNA molecule. In other cases, the protein-binding segment of a DNA-targeting RNA comprises two separate molecules that are hybridized along a region of complementarity.

A guiding polynucleic acid can comprise two separate polynucleic acid molecules or a single polynucleic acid molecule. An exemplary single molecule guiding polynucleic acid (e.g., guide RNA) comprises both a DNA-targeting segment and a protein-binding segment.

In some cases, an RHDC polypeptide or portion thereof can form a complex with a guiding polynucleic acid. A guiding polynucleic acid can provide target specificity to a complex by comprising a nucleotide sequence that can be complementary to a sequence of a target nucleic acid. In some cases, a target nucleic acid can comprise at least a portion of a gene. In some cases, a target nucleic acid can be within an exon of a gene. In other cases, a target nucleic acid can be within an intron of a gene.

A guiding polynucleic acid can complex with an RHDC polypeptide to provide the RHDC polypeptide site-specific activity. In other words, an RHDC polypeptide can be guided to a target site within a single stranded target nucleic acid sequence e.g. a single stranded region of a double stranded nucleic acid, a chromosomal sequence or an extra-chromosomal sequence, e.g. an episomal sequence, a mini-circle sequence, a mitochondrial sequence, a chloroplast sequence, an ssRNA, an ssDNA, etc. by virtue of its association with a guiding polynucleic acid.

In some cases a guiding polynucleic acid can comprise one or more modifications (e.g., a base modification, a backbone modification), to provide the nucleic acid with a new or enhanced feature (e.g., improved stability). A guiding polynucleic acid can comprise a nucleic acid affinity tag. A nucleoside can be a base-sugar combination. A base portion of the nucleoside can be a heterocyclic base. The two most common classes of such heterocyclic bases can be purines and pyrimidines. Nucleotides can be nucleosides that further include a phosphate group covalently linked to a sugar portion of a nucleoside. For those nucleosides that include a pentofuranosyl sugar, a phosphate group can be linked to the 2', the 3', or the 5' hydroxyl moiety of a sugar. In forming guiding polynucleic acids, a phosphate group can covalently link adjacent nucleosides to one another to form a linear polymeric compound. In addition, linear compounds may have internal nucleotide base complementarity and may therefore fold in a manner as to produce a fully or partially double-stranded compound. Within guiding polynucleic acids, a phosphate groups can commonly be referred to as forming a internucleoside backbone of a guiding polynucleic acid. The linkage or backbone of the guiding polynucleic acid can be a 3' to 5' phosphodiester linkage. In some cases, a guiding polynucleic acid can comprise nucleoside analogs, which can be oxy- or deoxy-analogues of a naturally-occurring DNA and RNA nucleosides deoxycytidine, deoxyuridine, deoxyadenosine, deoxyguanosine and thymidine. A guiding polynucleic acid can also include a universal base, such as deoxyinosine, or 5-nitroindole. A guiding polynucleic acid can comprise a modified backbone and/or modified internucleoside linkages. Modified backbones can include those that can retain a phosphorus atom in the backbone and those that do not have a phosphorus atom in the backbone. Suitable modified guiding polynucleic acid backbones containing a phosphorus atom therein can include, for example, phosphorothioates, chiral phosphorothioates, phosphorodithioates, phosphotriesters, aminoalkylphosphotriesters, methyl and other alkyl phosphonates such as 3'-alkylene phosphonates, 5'-alkylene phosphonates, chiral phosphonates, phosphinates, phosphoramidates including 3'-amino phosphoramidate and aminoalkylphosphoramidates, phosphorodiamidates, thionophosphoramidates, thionoalkylphosphonates, thionoalkylphosphotriesters, selenophosphates, and boranophosphates having normal 3'-5' linkages, 2'-5' linked analogs, and those having inverted polarity wherein one or more internucleotide linkages is a 3' to 3', a 5' to 5' or a 2' to 2' linkage. Suitable guiding polynucleic acids having inverted polarity can comprise a single 3' to 3' linkage at the 3'-most internucleotide linkage (i.e. a single inverted nucleoside residue in which the nucleobase is missing or has a hydroxyl group in place thereof).

In some cases, a guiding polynucleic acid (e.g., a guide RNA) can also comprise a tail region at a 5' or 3' end that can be essentially single-stranded. For example, a tail region is sometimes not complementarity to any chromosomal sequence in a cell of interest and can sometimes not be complementary to the rest of a guide polynucleic acid. Further, the length of a tail region can vary. A tail region can be more than or more than about 4 nucleotides in length. For example, the length of a tail region can range from or from about 5 to from or from about 60 nucleotides in length.

In some cases, a guiding polynucleic acid can bind to a region of a genome adjacent to a protospacer adjacent motif (PAM). A guide nucleic acid can comprise a nucleotide sequence (e.g., a spacer), for example, at or near a 5' end or 3' end, that can hybridize to a sequence in a target nucleic acid (e.g., a protospacer). A spacer of a guide nucleic acid can interact with a target nucleic acid in a sequence-specific manner via hybridization (i.e., base pairing). A spacer sequence can hybridize to a target nucleic acid that is located 5' or 3' of a protospacer adjacent motif (PAM). The length of a spacer sequence can be at least or at least about 5, 10, 15, 16, 17, 18, 19, 20, 21, 22, 23, 24, 25, 30 or more nucleotides. The length of a spacer sequence can be at most or at most about 5, 10, 15, 16, 17, 18, 19, 20, 21, 22, 23, 24, 25, 30 or more nucleotides. In some cases, a guiding polynucleic acid can bind to a region from about 1 to about 20 base pairs adjacent to a PAM. In other cases, a guiding polynucleic acid can bind from about 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, or up to 85 base pairs away from a PAM. Generally, a guiding polynucleic acid binding region can be designed to complement or substantially complement the target nucleic acid sequence or sequences. In some cases, a binding region of a guiding polynucleic acid can incorporate wobble or degenerate bases to bind multiple sequences. In some cases, the binding region can be altered to increase stability. For example, non-natural nucleotides can be incorporated to increase RNA resistance to degradation. In some cases, the binding region can be altered or designed to avoid or reduce secondary structure formation in the binding region. In some cases, the binding region can be designed to optimize G-C content. In some cases, G-C content is preferably between about 40% and about 60% (e.g., 40%, 45%, 50%, 55%, and 60%). In some cases, the binding region can contain modified nucleotides such as, without limitation, methylated or phosphorylated nucleotides.

In some cases, a guiding polynucleic acid can also comprise a double strand duplex region that can form a secondary structure. For example, a secondary structure formed by a guiding polynucleic acid can comprise a stem (or hairpin) and a loop. A length of a loop and a stem can vary. For example, a loop can range from about 3 to about 10 nucleotides in length, and a stem can range from about 6 to about 20 base pairs in length. A stem can comprise one or more bulges of 1 to about 10 nucleotides. The overall length of a second region can range from about 16 to about 60 nucleotides in length. For example, a loop can be or can be about 4 nucleotides in length and a stem can be or can be about 12 base pairs. In some cases, a 5' stem-loop region can be between about 15 and about 50 nucleotides in length (e.g., about 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or about 50 nucleotides in length). In some cases, a 5' stem-loop region is between about 30-45 nucleotides in length (e.g., about 31, 32, 33, 34, 35, 36, 37, 38, 39, 40, 41, 42, 43, 44, or 45 nucleotides in length). In some cases, a 5' stem-loop region is at least about 31 nucleotides in length (e.g., at least about 31, 32, 33, 34, 35, 36, 37, 38, 39, 40, 41, 42, 43, 44, or 45 nucleotides in length). In some cases, a 5' stem-loop structure contains one or more loops or bulges, each loop or bulge of about 1, 2, 3, 4, 5, 6, 7, 8, 9, or 10 nucleotides. In some cases, a 5' stem-loop structure contains a stem of between about 10 and 30 complementary base pairs (e.g., 11, 12, 13, 14, 15, 16, 17, 18, 19, 20, 21, 22, 23, 24, 25, 26, 27, 28, 29, or 30 complementary base pairs). In some cases, a 5' stem-loop structure can contain protein-binding, or small molecule-binding structures. In some cases, a 5' stem-loop function (e.g., interacting or assembling with a guiding polynucleic acid-guided nuclease) can be conditionally activated by drugs, growth factors, small molecule ligands, or a protein that binds to the protein-binding structure of the 5' stem-loop. In some cases, a 5' stem-loop structure can contain non-natural nucleotides. For example, non-natural nucleotides can be incorporated to enhance protein-RNA interaction, protein DNA interaction, or to increase the thermal stability or resistance to degradation of the guiding polynucleic acid.

In some cases, a guiding polynucleic acid may have an intervening sequence between the 5' and 3' stem-loop structures that can be between about 10 and about 50 nucleotides in length (e.g., about 10, 1 1, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or about 50 nucleotides in length). In some cases, the intervening sequence is designed to be linear, unstructured, substantially linear, or substantially unstructured. In some embodiments, the intervening sequence can contain non-natural nucleotides. For example, non-natural nucleotides can be incorporated to enhance protein-RNA interaction or to increase the activity of the gRNA:nuclease complex. As another example, natural nucleotides can be incorporated to enhance the thermal stability or resistance to degradation of the gRNA. In some cases, a 3' stem-loop structure can contain about 3, 4, 5, 6, 7, or 8 nucleotide loop and an about 4, 5, 6, 7, 8, 9, 10, 11, 12, 13, 14, 15, 16, 17, 18, 19, 20, 21, 22, 23, 24, or 25 nucleotide or longer stem. In some cases, the 3' stem-loop can contain a protein-binding, small molecule-binding, hormone-binding, or metabolite-binding structure that can conditionally stabilize the secondary and/or tertiary structure of the gRNA. In some embodiments, the 3' stem-loop can contain non-natural nucleotides. For example, non-natural nucleotides can be incorporated to enhance protein-guiding nucleic acid interaction or to increase the activity of the guiding polynucleic acid:nuclease complex.

As another example, natural nucleotides can be incorporated to enhance the thermal stability or resistance to degradation of the gRNA or gDNA.

In some cases, a guiding polynucleic acid can include a termination structure at its 3' end. In some cases, a guiding polynucleic acid can include an additional 3' hairpin structure, e.g., before the termination structure, that can interact with proteins, small-molecules, hormones, or the like, for stabilization or additional functionality, such as conditional stabilization or conditional regulation of a guiding polynucleic acid:nuclease assembly or activity. In some cases, a guiding polynucleic acid can be optimized to enhance stability, assembly, and/or expression. In some case, a guiding polynucleic acid can be optimized to enhance the activity of a guiding polynucleic acid:nuclease complex as compared to control or comparable guiding polynucleic acid:nuclease structures (gRNA, CRISPR RNP, unmodified gRNA, or unmodified guiding polynucleic acids). In some cases, a guiding polynucleic acid can be optimized for expression by substituting, deleting, or adding one or more nucleotides. In some cases, a nucleotide sequence that provides inefficient transcription from an encoding template nucleic acid can be deleted or substituted. For example, in some cases, a guiding polynucleic acid can be transcribed from a nucleic acid operably linked to an RNA polymerase III promoter. In some cases, a guiding polynucleic acid can be modified for increased stability. Stability can be enhanced by optimizing the stability of the guiding polynucleic acid:nuclease interaction, optimizing assembly of the guiding polynucleic acid:nuclease complex, removing or altering RNA or DNA destabilizing sequence elements, or adding RNA or DNA stabilizing sequence elements. In some embodiments, a guiding polynucleic acid can contain a 5' stem-loop structure proximal to, or adjacent to, the binding region that interacts with the guiding polynucleic acid-guided nuclease. Optimization of the 5' stem-loop structure can provide enhanced stability or assembly of the guiding polynucleic acid:nuclease complex. In some cases, the 5' stem-loop structure is optimized by increasing the length of the stem portion of the stem-loop structure. For example, a 5' stem-loop optimization can be combined with mutations for increased transcription to provide an optimized guiding polynucleic acid. For example, an A-U flip and an elongated stem loop can be combined to provide an optimized guiding polynucleic acid.

A double stranded-guiding polynucleic acid duplex region can comprise a protein-binding segment that can form a complex with an RNA or DNA-binding protein, such as an Argonaute protein, polypeptide, or functional portion thereof.

In some cases, a guiding polynucleic acid can comprise a modification. A modification can be a chemical modification. A modification can be selected from 5'adenylate, 5' guanosine-triphosphate cap, 5'N7-Methylguanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2' deoxyribonucleoside analog purine, 2' deoxyribonucleoside analog pyrimidine, ribonucleoside analog, 2'-O-methyl ribonucleoside analog, sugar modified analogs, wobble/universal bases, fluorescent dye label, 2'fluoro RNA, 2'O-methyl RNA, methylphosphonate, phosphodiester DNA, phosphodiester RNA, phosphothioate DNA, phosphorothioate RNA, UNA, pseudouridine-5'-triphosphate, 5-methylcytidine-5'-triphosphate, 2-O-methyl 3phosphorothioate or any combinations thereof. A modification can be a pseudouridine modification. In some cases, a modification cannot affect viability.

In some cases, a modification is a 2-O-methyl 3 phosphorothioate addition. A 2-O-methyl 3 phosphorothioate addition can be performed from 1 base to 150 bases. A 2-O-methyl 3 phosphorothioate addition can be performed from 1 base to 4 bases. A 2-O-methyl 3 phosphorothioate addition can be performed on 2 bases. A 2-O-methyl 3 phosphorothioate addition can be performed on 4 bases. A modification can also be a truncation. A truncation can be a 5 base truncation. Guiding polynucleic acids can be modified by methods known in the art. In some cases, the modifications can include, but are not limited to, the addition of one or more of the following sequence elements: a 5' cap (e.g., a 7-methylguanylate cap); a 3' polyadenylated tail; a riboswitch sequence; a stability control sequence; a hairpin; a subcellular localization sequence; a detection sequence or label; or a binding site for one or more proteins. Modifications can also include the introduction of non-natural nucleotides including, but not limited to, one or more of the following: fluorescent nucleotides and methylated nucleotides. In some embodiments, a guiding polynucleic acid can contain from 5' to 3': (i) a binding region of between about 10 and about 50 nucleotides; (ii) a 5' hairpin region containing fewer than four consecutive uracil nucleotides, or a length of at least 31 nucleotides (e.g., from about 31 to about 41 nucleotides); (iii) a 3' hairpin region; and (iv) a transcription termination sequence, wherein the small guide RNA is configured to form a complex with a guiding polynucleic acid-guided nuclease, the complex having increased stability or activity relative to an unmodified complex.

A guide RNA or guide DNA can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30 or more nucleotides. A target nucleic acid can be at most or at most about 5, 10, 15, 16, 17, 18, 19, 20, 21, 22, 23, 24, 25, 30 or more nucleotides. A target nucleic acid sequence can be or can be about 20 bases immediately 5' of the first nucleotide of the PAM. A guide RNA or guide DNA can target a nucleic acid sequence comprising a gene or portion thereof.

A guide RNA or guide DNA can target a genomic sequence comprising a gene. A gene that can be targeted can be involved in a disease. A disease can be a cancer, a cardiovascular condition, a reproductive condition, a neurological disease, an immunological disease, an organ condition, degeneration, an ocular condition, diabetes, a vascular condition, or a gastrointestinal condition.

A gene that can be disrupted can be a member of a family of genes. For example, a gene that can be disrupted can improve therapeutic potential of cancer immunotherapy. A gene that can be disrupted can ameliorate one or more symptoms or complications associated with human genetic diseases.

A gene that can be disrupted can be involved in attenuating TCR signaling, functional avidity, or immunity to cancer. In some cases, a gene to be disrupted is upregulated when a TCR is stimulated. A gene can be involved in inhibiting cellular expansion, functional avidity, or cytokine polyfunctionality. A gene can be involved in negatively regulating cellular cytokine production. For example, a gene can be involved in inhibiting production of effector cytokines, IFN-gamma and/or TNF for example. A gene can also be involved in inhibiting expression of supportive cytokines such as IL-2 after TCR stimulation.

A disease can be a neoplasia. Genes associated with neoplasia can be: PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bc12; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bc12; caspases family (9 members: 1, 2, 3, 4, 6, 7, 8, 9, 12); Kras; Apc. A disease can be age-related macular degeneration. Genes associated with macular degeneration can be: Abcr; Ccl2; Cc2; cp (ceruloplasmin); Timp3; cathepsinD; Vldlr; Ccr2. A disease can be schizophrenia. Genes associated with schizophrenia can be: Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b. A disorder can be associated with a gene such as: 5-HTT (Slc6a4); COMT; DRD (Drd1a); SLC6A3; DAOA; DTNBP1; Dao (Dao1). A disease can be a trinucleotide repeat disorder. A trinucleotide repeat disorder can be associated with genes such as: HTT (Huntington's Dx); SBMA/SMAX1/AR (Kennedy's Dx); FXN/X25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP—global instability); VLDLR (Alzheimer's); Atxn7; Atxn10. A disease can be fragile X syndrome. Genes associated with fragile X syndrome can be: FMR2; FXR1; FXR2; mGLUR5. A disease can be secretase related with associated genes selected from: APH-1 (alpha and beta); Presenilin (Psen1); nicastrin, (Ncstn); PEN-2; Nos1; Parp1; Nat1; Nat2. A disease can be a prion related disorder with relevant genes being selected from: Prp. A disease can be ALS with relevant genes being: SOD1; ALS2; STEX; FUS; TARDBP; VEGF (VEGF-a; VEGF-b; VEGF-c). A disease can be drug addiction with relevant genes being; Prkce (alcohol); Drd2; Drd4; ABAT (alcohol); GRIA2; Grm5; Grin1; Htr1b; Grin2a; Drd3; Pdyn; Gria1 (alcohol). A disease can be autism with relevant genes being selected from: Mecp2; BZRAP1; MDGA2; Sema5A; Neurexin 1; Fragile X (FMR2 (AFF2); FXR1; FXR2; Mglur5). A disease can be Alzheimer's disease with relevant genes being selected from: E1; CHIP; UCH; UBB; Tau; LRP; PICALM; Clusterin; PS1; SORL1; CR1; Vldlr; Uba1; Uba3; CHIP28 (Aqpl, Aquaporin 1); Uchl1; Uchl3; APP. A disease can be inflammation with relevant genes being selected from: IL-10; IL-1 (IL-1a; IL-1b); IL-13; IL-17 (IL-17a (CTLA8); IL-17b; IL-17c; IL-17d; IL-17f); 11-23; Cx3crl; ptpn22; TNFa; NOD2/CARD15 for IBD; IL-6; IL-12 (IL-12a; IL-12b); CTLA4; Cx3c11. A disease can be Parkinson's disease with relevant genes being selected from: x-Synuclein; DJ-1; LRRK2; Parkin; PINK1. A disease can be a blood and coagulation disorders: Anemia (CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT); Bare lymphocyte syndrome (TAPBP, TPSN, TAP2, ABCB3, PSF2, RING11, MHC2TA, C2TA, RFX5, RFXAP, RFX5); Bleeding disorders (TBXA2R, P2RX1, P2X1); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, F1134064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, KIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1). Cell dysregulation and oncology diseases and disorders: B-cell non-Hodgkin lymphoma (BCL7A, BCL7); Leukemia (TALI TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9S46E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9S46E, CAN, CAIN). A disease can be an inflammation and/or an immune related diseases and disorders: AIDS (KIR3DL1, NKAT3, NKB1, AMB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), 11-23, Cx3cr1, ptpn22, TNFa, NOD2/CARD15 for IBD, IL-6, IL-12 (IL-12a, IL-12b), CTLA4, Cx3c11); Severe combined immunodeficiencies (SCIDs)(JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4). A disease can be metabolic, liver, kidney and protein diseases and disorders: Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). A disease can be muscular/skeletal diseases and disorders: Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LRP5, BMND1, LRP7, LR3, OPPG, VBCH2, CLCN7, CLC7, OPTA2, OSTM1, GL, TCIRG1, TIRC7, OC116, OPTB1); Muscular atrophy (VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1). A disease can be neurological and neuronal diseases and disorders: ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCP1, ACE1, MPO, PACIP1, PAXIP1L, PTIP, A2M, BLMH, BMH, PSEN1, AD3); Autism (Mecp2, BZRAP1, MDGA2, Sema5A, Neurexin 1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJ1, PARK7, LRRK2, PARK8, PINK1, PARK6, UCHL1, PARK5, SNCA, NACP, PARK1, PARK4, PRKN, PARK2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cplx1), Tph1 Tryptophan hydroxylase, Tph2, Tryptophan hydroxylase 2, Neurexin 1, GSK3, GSK3a, GSK3b, 5-HTT (Slc6a4), COMT, DRD (Drd1a), SLC6A3, DAOA, DTNBP1, Dao (Dao1)); Secretase Related Disorders (APH-1 (alpha and beta), Presenilin (Psenl), nicastrin, (Ncstn), PEN-2, Nos1, Parp1, Nat1, Nat2); Trinucleotide Repeat Disorders (HTT (Huntington's Dx), SBMA/SMAX1/AR (Kennedy's Dx), FXN/X25 (Friedrich's Ataxia), ATX3 (Machado-Joseph's Dx), ATXN1 and ATXN2 (spinocerebellar ataxias), DMPK (myotonic dystrophy), Atrophin-1 and Atn1 (DRPLA Dx), CBP (Creb-BP—global instability), VLDLR (Alzheimer's), Atxn7, Atxn10). A disease can be an Ocular disease and/or disorder: Age-related macular degeneration (Abcr, Cc12, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQPO, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLC1A, JOAG, GPOA, OPTN, GLC1E, FIP2, HYPL, NRP, CYP1B1, GLC3A, OPA1, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2).

In some cases a disease that can be treated with the disclosed editing system can be associated with a cellular condition. For example, genes associated with cellular performance may be disrupted with the disclosed editing system: PI3K/AKT Signaling: PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1. For example, ERK/MAPK Signaling: PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK. Glucocorticoid Receptor Signaling: RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1. Axonal Guidance Signaling: PRKCE; ITGAM; ROCK1; ITGA5; CXCR4; ADAM12; IGF1; RAC1; RAP1A; E1F4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA. Ephrin Receptor Signaling: PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4;

AKT3; SGK. Actin Cytoskeleton Signaling: ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK. Huntington's Disease Signaling: PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKC1; HSPA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3. Apoptosis Signaling: PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1. B Cell Receptor Signaling: RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1. Leukocyte Extravasation Signaling: ACTN4; CD44; PRKCE; ITGAM; ROCK1; CXCR4; CYBA; RAC1; RAP1A; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MMP1; MMP9. Integrin Signaling: ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3. Acute Phase Response Signaling: IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6. PTEN Signaling: ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1. p53 Signaling: PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF10B; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3. Aryl Hydrocarbon Receptor Signaling: HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1. Xenobiotic Metabolism Signaling. PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1. SAPK/JNK Signaling: PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK. PPAr/RXR Signaling: PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ. NF-KB Signaling. IRAK1; EIF2AK2; EP300; INS; MYD88; PRKCZ: TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1. Neuregulin Signaling: ERBB4; PRKCE; ITGAM; ITGA5: PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1. Wnt & Beta catenin Signaling. CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2. Insulin Receptor Signaling: PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1. IL-6 Signaling: HSPB1; TRAF6; MAPKAPK2; ELK1; MAPK1; PTPN11; IKBKB; FOS; NFKB2: MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6. Hepatic Cholestasis: PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6. IGF-1 Signaling: IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1. NRF2-mediated Oxidative Stress Response: PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1; GSK3B; ATF4; PRKCA; EIF2AK3; HSP90AA1. Hepatic Fibrosis/Hepatic Stellate Cell Activation: EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MMP1; STAT1; IL6; CTGF; MMP9. PPAR Signaling: EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1. Fc Epsilon RI Signaling: PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA. G-Protein Coupled Receptor Signaling: PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA, Inositol Phosphate Metabolism: PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK. PDGF Signaling: EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF;
STAT1; SPHK2. VEGF Signaling: ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA. Natural Killer Cell Signaling: PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA. Cell Cycle: G1/S Checkpoint Regulation: HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6. T Cell Receptor Signaling: RAC1; ELK1; MAPK1; IKBKB; CBL; PIK3CA; FOS; NFKB2; PIK3CB; PIK3C3; MAPK8; MAPK3; KRAS; RELA, PIK3C2A; BTK; LCK; RAF1; IKBKG; RELB, FYN; MAP2K2; PIK3R1; CHUK; MAP2K1; NFKB1; ITK; BCL10; JUN; VAV3. Death Receptor Signaling: CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3. FGF Signaling: RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF. GM-CSF Signaling. LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1. Amyotrophic Lateral Sclerosis Signaling: BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3. JAK/Stat Signaling: PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1. Nicotinate and Nicotinamide Metabolism: PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK. Chemokine Signaling: CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA. IL-2 Signaling: ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3. Synaptic Long Term Depression: PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA. Estrogen Receptor Signaling: TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1;

ESR2. Protein Ubiquitination Pathway: TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USPS; USP1; VHL; HSP90AA1; BIRC3. IL-10 Signaling: TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6. VDR/RXR Activation: PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA. TGF-beta Signaling: EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5. Toll-like Receptor Signaling: IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN. p38 MAPK Signaling: HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1. Neurotrophin/TRK Signaling: NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4. FXR/RXR Activation: INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1. Synaptic Long Term Potentiation: PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA. Calcium Signaling. RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6. EGF Signaling: ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1. Hypoxia Signaling in the Cardiovascular System: EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1. LPS/IL-1 Mediated Inhibition of RXR Function LXR/RXR Activation: IRAK1; MYD88; TRAF6; PPARA; RXRA; ABCA1, MAPK8; ALDH1A1; GSTP1; MAPK9; ABCB1; TRAF2; TLR4; TNF; MAP3K7; NR1H2; SREBF1; JUN; IL1R1 FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9. Amyloid Processing: PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP. IL-4 Signaling: AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1. Cell Cycle: G2/M DNA Damage Checkpoint Regulation: EP300; PCAF; BRCA1; GADD45A; PLK1; BTRC; CHEK1; ATR; CHEK2; YWHAZ; TP53; CDKN1A; PRKDC; ATM; SFN; CDKN2A. Nitric Oxide Signaling in the Cardiovascular System: KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1. Purine Metabolism: NME2; SMARCA4; MYH9; RRM2; ADAR; EIF2AK4; PKM2; ENTPD1; RAD51; RRM2B; TJP2; RAD51C; NT5E; POLD1; NME1. cAMP-mediated Signaling: RAP1A; MAPK1; GNAS; CREB1; CAMK2A; MAPK3; SRC; RAF1; MAP2K2; STAT3; MAP2K1; BRAF; ATF4. Mitochondrial Dysfunction Notch Signaling: SOD2; MAPK8; CASP8; MAPK10; MAPK9; CASP9; PARK7; PSEN1; PARK2; APP; CASP3 HES1; JAG1; NUMB; NOTCH4; ADAM17; NOTCH2; PSEN1; NOTCH3; NOTCH1; DLL4. Endoplasmic Reticulum Stress Pathway: HSPA5; MAPK8; XBP1; TRAF2; ATF6; CASP9; ATF4; EIF2AK3; CASP3. Pyrimidine Metabolism: NME2; AICDA; RRM2; EIF2AK4; ENTPD1; RRM2B; NT5E; POLD1; NME1. Parkinson's Signaling: UCHL1; MAPK8; MAPK13; MAPK14; CASP9; PARK7; PARK2; CASP3. Cardiac & Beta Adrenergic Signaling: GNAS; GNAQ; PPP2R1A; GNB2L1; PPP2CA; PPP1CC; PPP2R5C. Glycolysis/Gluconeogenesis: HK2; GCK; GPI; ALDH1A1; PKM2; LDHA; HK1. Interferon Signaling: IRF1; SOCS1; JAK1; JAK2; IFITM1; STAT1; IFIT3. Sonic Hedgehog Signaling: ARRB2; SMO; GLI2; DYRK1A; GLI1; GSK3B; DYRKIB. Glycerophospholipid Metabolism: PLD1; GRN; GPAM; YWHAZ; SPHK1; SPHK2. Phospholipid Degradation: PRDX6; PLD1; GRN; YWHAZ; SPHK1; SPHK2. Tryptophan Metabolism: SIAH2; PRMT5; NEDD4; ALDH1A1; CYP1B1; SIAH1. Lysine Degradation: SUV39H1; EHMT2; NSD1; SETD7; PPP2R5C. Nucleotide Excision Repair Pathway: ERCC5; ERCC4; XPA; XPC; ERCC1. Starch and Sucrose Metabolism: UCHL1; HK2; GCK; GPI; HK1. Aminosugars Metabolism: NQO1; HK2; GCK; HK1. Arachidonic Acid Metabolism: PRDX6; GRN; YWHAZ; CYP1B1. Circadian Rhythm Signaling: CSNK1E; CREB1; ATF4; NR1D1. Coagulation System: BDKRB1; F2R; SERPINE1; F3. Dopamine Receptor Signaling: PPP2R1A; PPP2CA; PPP1CC; PPP2R5C. Glutathione Metabolism: IDH2; GSTP1; ANPEP; IDH1. Glycerolipid Metabolism: ALDH1A1; GPAM; SPHK1; SPHK2. Linoleic Acid Metabolism: PRDX6; GRN; YWHAZ; CYP1B1. Methionine Metabolism: DNMT1; DNMT3B; AHCY; DNMT3A. Pyruvate Metabolism: GLO1; ALDH1A1; PKM2; LDHA. Arginine and Proline Metabolism: ALDH1A1; NOS3; NOS2A. Eicosanoid Signaling: PRDX6; GRN; YWHAZ. Fructose and Mannose Metabolism: HK2; GCK; HK1. Galactose Metabolism: HK2; GCK; HK1. Stilbene, Coumarine and Lignin Biosynthesis: PRDX6; PRDX1; TYR. Antigen Presentation Pathway: CALR; B2M. Biosynthesis of Steroids: NQO1; DHCR7. Butanoate Metabolism: ALDH1A1; NLGN1. Citrate Cycle: IDH2; IDH1. Fatty Acid Metabolism: ALDH1A1; CYP1B1. Glycerophospholipid Metabolism: PRDX6; CHKA. Histidine Metabolism: PRMT5; ALDH1A1. Inositol Metabolism: ERO1L; APEX1. Metabolism of Xenobiotics by Cytochrome p450: GSTP1; CYP1B1. Methane Metabolism: PRDX6; PRDX1. Phenylalanine Metabolism: PRDX6; PRDX1. Propanoate Metabolism: ALDH1A1; LDHA. Selenoamino Acid Metabolism: PRMT5; AHCY. Sphingolipid Metabolism: SPHK1; SPHK2. Aminophosphonate Metabolism: PRMT5. Androgen and Estrogen Metabolism: PRMT5. Ascorbate and Aldarate Metabolism: ALDH1A1. Bile Acid Biosynthesis: ALDH1A1. Cysteine Metabolism: LDHA. Fatty Acid Biosynthesis: FASN. Glutamate Receptor Signaling: GNB2L1. NRF2-mediated Oxidative Stress Response: PRDX1. Pentose Phosphate Pathway: GPI. Pentose and Glucuronate Interconversions: UCHL1. Retinol Metabolism: ALDH1A1. Riboflavin Metabolism: TYR. Tyrosine Metabolism: PRMT5, TYR. Ubiquinone Biosynthesis: PRMT5. Valine, Leucine and Isoleucine Degradation: ALDH1A1. Glycine, Serine and Threonine Metabolism: CHKA. Lysine Degradation: ALDH1A1. Pain/Taste:

TRPM5; TRPA1. Pain: TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a. Mitochondrial Function: AIF; CytC; SMAC (Diablo); Aifm-1; Aifm-2. Developmental Neurology: BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab1; unc-86 (Pou4fl or Brn3a); Numb; Reln In some cases, an editing system can be used to improve an immune cell performance. Examples of genes involved in cancer or tumor suppression may include ATM (ataxia telangiectasia mutated), ATR (ataxia telangiectasia and Rad3 related), EGFR (epidermal growth factor receptor), ERBB2 (v-erb-b2 erythroblastic leukemia viral oncogene homolog 2), ERBB3 (v-erb-b2 erythroblastic leukemia viral oncogene homolog 3), ERBB4 (v-erb-b2 erythroblastic leukemia viral oncogene homolog 4), Notch 1, Notch2, Notch 3, or Notch 4, for example A gene and protein associated with a secretase disorder may also be disrupted or introduced and can include PSENEN (presenilin enhancer 2 homolog (C. elegans)), CTSB (cathepsin B), PSEN1 (presenilin 1), APP (amyloid beta (A4) precursor protein). APH1B (anterior pharynx defective 1 homolog B (C. elegans)), PSEN2 (presenilin 2 (Alzheimer disease 4)), or BACE1 (beta-site APP-cleaving enzyme 1). It is contemplated that genetic homologues (e.g., any mammalian version of the gene) of the genes within this applications are covered. For example, genes that can be targeted can further include CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, CCR5, AAVS SITE (e.g. AAVS1, AAVS2, ETC.), PPP1R12C, TRAC, TCRB, or CISH. Therefore, it is contemplated that any one of the aforementioned gene that exhibits or exhibits about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity (at the nucleic acid or protein level) can be disrupted. It is also contemplated that any of the aforementioned genes that exhibits or exhibits about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity (at the nucleic acid or protein level) can be disrupted. Some genetic homologues are known in the art, however, in some cases, homologues are unknown. However, homologous genes between mammals can be found by comparing nucleic acid (DNA or RNA) sequences or protein sequences using publically available databases such as NCBI BLAST. Also disclosed herein can be non-human gene equivalents of any one of the aforementioned genes. A non-human equivalent of any of the aforementioned genes can be disrupted with the gene editing system disclosed herein.

A guide RNA can be introduced into a cell or embryo as an RNA molecule. For example, a RNA molecule can be transcribed in vitro and/or can be chemically synthesized. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III).

A nucleic acid encoding a guide RNA or guide DNA can be linear. A nucleic acid encoding a guide RNA or guide DNA can also be circular. A nucleic acid encoding a guiding polynucleic acid can also be part of a vector. Some examples of vectors can include plasmid vectors, phagemids, cosmids, artificial/mini-chromosomes, transposons, and viral vectors. For example, a DNA encoding a RNA-guided endonuclease is present in a plasmid vector. Other non-limiting examples of suitable plasmid vectors include pUC, pBR322, pET, pBluescript, and variants thereof. Further, a vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like.

Suitable methods for introduction of the guiding polynucleic acid, protein, or guiding polynucleic acid:nuclease complex are known in the art and include, for example, electroporation; calcium phosphate precipitation; or PEI, PEG, DEAE, nanoparticle, or liposome mediated transformation. Other suitable transfection methods include direct micro-injection. In some cases, the guiding polynucleic acid and nuclease are introduced separately and the guiding polynucleic acid:nuclease complexes are formed in a cell. In other cases, a guiding polynucleic acid:nuclease complex can be formed and then introduced into a cell. In some cases, multiple, differentially labeled, guiding polynucleic acid: nuclease complexes, each directed to a different genomic targets are formed and then introduced into a cell. When both a nucleic acid guided nuclease and a guide polynucleic acid are introduced into a cell, each can be part of a separate molecule (e.g., one vector containing fusion protein coding sequence and a second vector containing guide polynucleic acid coding sequence) or both can be part of a same molecule (e.g., one vector containing coding (and regulatory) sequence for both a fusion protein and a guiding polynucleic acid). In some cases, a nuclease can be precomplexed with a guiding polynucleic acid. A complex can be a ribonucleoprotein (RNP) complex.

In some cases, a GUIDE-Seq analysis can be performed to determine the specificity of engineered guiding polynucleic acids. The general mechanism and protocol of GUIDE-Seq profiling of off-target cleavage by CRISPR system nucleases is discussed in Tsai, S. et al., "GUIDE-Seq enables genome-wide profiling of off-target cleavage by CRISPR system nucleases," Nature, 33: 187-197 (2015).

A guiding polynucleic acid can be introduced at any functional concentration. For example, a guiding polynucleic acid can be introduced to a cell at 10 micrograms. In other cases, a guiding polynucleic acid can be introduced from 0.5 micrograms to 100 micrograms. A gRNA can be introduced from 0.5, 5, 10, 15, 20, 25, 30, 35, 40, 45, 50, 55, 60, 65, 70, 75, 80, 85, 90, 95, or 100 micrograms.

A sequence of a guiding polynucleic acid need not be 100% complementary to that of its target nucleic acid to be specifically hybridizable or hybridizable. Moreover, a guiding polynucleic acid may hybridize over one or more segments such that intervening or adjacent segments are not involved in the hybridization event (e.g., a loop structure or hairpin structure). For example, a polynucleotide can comprise 60% or more, 65% or more, 70% or more, 75% or more, 80% or more, 85% or more, 90% or more, 95% or more, 98% or more, 99% or more, 99.5%, or 100% sequence complementarity to a target region within the target nucleic acid sequence to which it will hybridize. For example, an antisense nucleic acid in which 18 of 20 nucleotides of the antisense compound are complementary to a target region, and would therefore specifically hybridize, would represent 90 percent complementarity. In this example, the remaining non-complementary nucleotides may be clustered or interspersed with complementary nucleotides and need not be contiguous to each other or to complementary nucleotides. Percent complementarity between particular stretches of nucleic acid sequences within nucleic acids can be determined using any convenient method. Exemplary methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489).

A guiding polynucleic acid can target a gene or portion thereof. In some cases, a cell that is modified can comprise one or more suppressed, disrupted, or knocked out genes and one or more transgenes, such as a receptor.

Methods and compositions described herein can be used to target a gene from a mammal. A gene that can be targeted can be from any organ or tissue. A gene that can be targeted can be from skin, eyes, heart, liver, lung, kidney, reproductive tract, brain, to name a few. A gene that can be targeted can also be from a number of conditions and diseases In some cases, a disruption can result in a reduction of copy number of genomic transcript of a disrupted gene or portion thereof. For example, a target gene that can be disrupted can have reduced transcript quantities compared to the same target gene in an undisrupted cell. A disruption can result in disruption results in less than 145 copies/µL, 140 copies/µL, 135 copies/µL, 130 copies/µL, 125 copies/µL, 120 copies/µL, 115 copies/µL, 110 copies/µL, 105 copies/µL, 100 copies/µL, 95 copies/µL, 190 copies/µL, 185 copies/µL, 80 copies/µL, 75 copies/µL, 70 copies/µL, 65 copies/µL, 60 copies/µL, 55 copies/µL, 50 copies/µL, 45 copies/µL, 40 copies/µL, 35 copies/µL, 30 copies/µL, 25 copies/µL, 20 copies/µL, 15 copies/µL, 10 copies/µL, 5 copies/µL, 1 copies/µL, or 0.05 copies/µL. In some cases, a disruption can result in less than 100 copies/µL.

One or more genes in a cell can be knocked out or disrupted using any method. For example, knocking out one or more genes can comprise deleting one or more genes from a genome of a cell. Knocking out can also comprise removing all or a part of a gene sequence from a cell. It is also contemplated that knocking out can comprise replacing all or a part of a gene in a genome of a cell with one or more nucleotides. Knocking out one or more genes can also comprise inserting a sequence in one or more genes thereby disrupting expression of the one or more genes. For example, inserting a sequence can generate a stop codon in the middle of one or more genes. Inserting a sequence can also shift the open reading frame of one or more genes.

An animal or cell may comprise 1, 2, 3, 4, 5, 6, 7, 8, 9, 10, 11, 12, 13, 14, 15 or more disrupted genomic sequences encoding a protein associated with a disease and zero, 1, 2, 3, 4, 5, 6, 7, 8, 9, 10, 11, 12, 13, 14, 15 or more genomically integrated sequences encoding a protein associated with a disease.

Delivery into a Cell

The RHDC and nucleic acid unwinding agents, polynucleotides encoding the same, and/or any transgene polynucleotides and compositions comprising the polypeptides and/or polynucleotides described herein can be delivered to a target cell by any suitable means.

Suitable cells can include but are not limited to eukaryotic and prokaryotic cells and/or cell lines. A suitable cell can be a human primary cell.

A primary cell can be taken directly from living tissue (i.e. biopsy material) and established for growth in vitro, that have undergone very few population doublings and are therefore more representative of the main functional components and characteristics of tissues from which they are derived from, in comparison to continuous tumorigenic or artificially immortalized cell lines.

A primary cell can be acquired from a variety of sources such as an organ, vasculature, buffy coat, whole blood, apheresis, plasma, bone marrow, tumor, cell-bank, cryopreservation bank, or a blood sample. A primary cell can be a stem cell. A suitable cell that can be edited with a genomic editing system comprising an Ranse-H like domain can be epithelial cells, fibroblast cells, neural cells, keratinocytes, hematopoietic cells, melanocytes, chondrocytes, lymphocytes (B, NK, and T), macrophages, monocytes, mononuclear cells, cardiac muscle cells, other muscle cells, granulosa cells, cumulus cells, epidermal cells, endothelial cells, pancreatic islet cells, blood cells, blood precursor cells, bone cells, bone precursor cells, neuronal stem cells, primordial stem cells, hepatocytes, keratinocytes, umbilical vein endothelial cells, aortic endothelial cells, microvascular endothelial cells, fibroblasts, liver stellate cells, aortic smooth muscle cells, cardiac myocytes, neurons, Kupffer cells, smooth muscle cells, Schwann cells, and epithelial cells, erythrocytes, platelets, neutrophils, lymphocytes, monocytes, eosinophils, basophils, adipocytes, chondrocytes, pancreatic islet cells, thyroid cells, parathyroid cells, parotid cells, tumor cells, glial cells, astrocytes, red blood cells, white blood cells, macrophages, epithelial cells, somatic cells, pituitary cells, adrenal cells, hair cells, bladder cells, kidney cells, retinal cells, rod cells, cone cells, heart cells, pacemaker cells, spleen cells, antigen presenting cells, memory cells, T cells, B cells, plasma cells, muscle cells, ovarian cells, uterine cells, prostate cells, vaginal epithelial cells, sperm cells, testicular cells, germ cells, egg cells, leydig cells, peritubular cells, sertoli cells, lutein cells, cervical cells, endometrial cells, mammary cells, follicle cells, mucous cells, ciliated cells, nonkeratinized epithelial cells, keratinized epithelial cells, lung cells, goblet cells, columnar epithelial cells, dopamiergic cells, squamous epithelial cells, osteocytes, osteoblasts, osteoclasts, dopaminergic cells, embryonic stem cells, fibroblasts and fetal fibroblasts. Further, the one or more cells can be pancreatic islet cells and/or cell clusters or the like, including, but not limited to pancreatic α cells, pancreatic β cells, pancreatic δ cells, pancreatic F cells (e.g., PP cells), or pancreatic E cells. In one instance, the one or more cells can be pancreatic α cells. In another instance, the one or more cells can be pancreatic β cells.

A human primary cell can be an immune cell. An immune cell can be a T cell, B cell, NK cell, and/or TIL. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), and perC6 cells as well as insect cells such as Spodopterafugiperda (Sf), or fungal cells such as Saccharomyces, Pichia and Schizosaccharomyces. In some cases, a cell line can be a CHO-K1, MDCK or HEK293 cell line. In some cases, suitable primary cells include peripheral blood mononuclear cells (PBMC), peripheral blood lymphocytes (PBL), and other blood cell subsets such as, but not limited to, T cell, a natural killer cell, a monocyte, a natural killer T cell, a monocyte-precursor cell, a hematopoietic stem cell or a non-pluripotent stem cell. In some cases, the cell can be any immune cells including any T-cell such as tumor infiltrating cells (TILs), such as CD3+ T-cells, CD4+ T-cells, CD8+ T-cells, or any other type of T-cell. The T cell can also include memory T cells, memory stem T cells, or effector T cells. The T cells can also be selected from a bulk population, for example, selecting T cells from whole blood. The T cells can also be expanded from a bulk population. The T cells can also be skewed towards particular populations and phenotypes. For example, the T cells can be skewed to phenotypically comprise, CD45RO(−), CCR7(+), CD45RA (+), CD62L(+), CD27(+), CD28(+) and/or IL-7Rα(+). Suitable cells can be selected that comprise one of more markers selected from a list comprising: CD45RO(−), CCR7(+), CD45RA(+), CD62L(+), CD27(+), CD28(+) and/or IL-7Rα (+). Suitable cells also include stem cells such as, by way of example, embryonic stem cells, induced pluripotent stem cells, hematopoietic stem cells, neuronal stem cells and mesenchymal stem cells. Suitable cells can comprise any number of primary cells, such as human cells, non-human cells, and/or mouse cells. Suitable cells can be progenitor cells. Suitable cells can be derived from the subject to be treated (e.g., subject). Suitable cells can be derived from a human donor. Suitable cells can be stem memory $T_{SCM}$ cells comprised of CD45RO (−), CCR7(+), CD45RA (+), CD62L+(L-selectin), CD27+, CD28+ and IL-7Rα+, stem memory cells can also express CD95, IL-2Rβ, CXCR3, and LFA-1, and show numerous functional attributes distinctive of stem memory cells. Suitable cells can be central memory $T_{CM}$ cells comprising L-selectin and CCR7, central memory cells can secrete, for example, IL-2, but not IFNγ or IL-4. Suitable cells can also be effector memory $T_{EM}$ cells comprising L-selectin or CCR7 and produce, for example, effector cytokines such as IFNγ and IL-4.

In some cases, modified cells can be a stem memory $T_{SCM}$ cell comprised of CD45RO (−), CCR7(+), CD45RA (+), CD62L+(L-selectin), CD27+, CD28+ and IL-7Rα+, stem memory cells can also express CD95, IL-2Rβ, CXCR3, and LFA-1, and show numerous functional attributes distinctive of stem memory cells. Engineered cells, such as RHDC polypeptide modified cells can also be central memory $T_{CM}$ cells comprising L-selectin and CCR7, where the central memory cells can secrete, for example, IL-2, but not IFNγ or IL-4. Engineered cells can also be effector memory $T_{EM}$ cells comprising L-selectin or CCR7 and produce, for example, effector cytokines such as IFNγ and IL-4. In some cases a population of cells can be introduced to a subject. For example, a population of cells can be a combination of T cells and NK cells. In other cases, a population can be a combination of naïve cells and effector cells.

A method of attaining suitable cells, such as human primary cells, can comprise selecting cells. In some cases, a cell can comprise a marker that can be selected for the cell. For example, such marker can comprise GFP, a resistance gene, a cell surface marker, an endogenous tag. Cells can be selected using any endogenous marker. Suitable cells can be selected using any technology. Such technology can comprise flow cytometry and/or magnetic columns. The selected cells can then be infused into a subject. The selected cells can also be expanded to large numbers. The selected cells can be expanded prior to infusion.

In some cases, a suitable cell can be a recombinant cell. A recombinant cell can be an immortalized cell line. A cell line can be: CHO-K1 cells; HEK293 cells; Caco2 cells; U2-OS cells; NIH 3T3 cells; NSO cells; SP2 cells; CHO-S cells; DG44 cells; K-562 cells, U-937 cells; MRCS cells; IMR90 cells; Jurkat cells; HepG2 cells; HeLa cells; HT-1080 cells; HCT-1 16 cells; Hu-h7 cells; Huvec cells; Molt 4 cells. All these cell lines can be modified by the method described herein to provide cell line models to produce, express, quantify, detect, study a gene or a protein of interest; these models can also be used to screen biologically active molecules of interest in research and production and various fields such as chemical, biofuels, therapeutics and agronomy as non-limiting examples.

The genomic editing system as described herein can be delivered using vectors, for example containing sequences encoding one or more of the proteins. In some cases, a system as described herein can be delivered absent a viral vector. In some cases, a system as described herein can be delivered absent a viral vector, for example, when the system is greater than one kilobase, without affecting cellular viability. Transgenes encoding polynucleotides can be similarly delivered. Any vector systems can be used including, but not limited to, plasmid vectors, retroviral vectors, lentiviral vectors, adenovirus vectors, poxvirus vectors; herpesvirus vectors and adeno-associated virus vectors, etc. Furthermore, any of these vectors can comprise one or more transcription factor, nuclease, and/or transgene. Thus, when one or more CRISPR, TALEN, transposon-based, ZFN, meganuclease, or Mega-TAL molecules and/or transgenes are introduced into the cell, CRISPR, TALEN, transposon-based, ZFN, meganuclease, or Mega-TAL molecules and/or transgenes can be carried on the same vector or on different vectors. When multiple vectors are used, each vector can comprise a sequence encoding one or multiple CRISPR, TALEN, transposon-based, ZFN, meganuclease, or Mega-TAL molecules and/or transgenes.

Conventional viral and non-viral based gene transfer methods can be used to introduce nucleic acids encoding engineered CRISPR, TALEN, transposon-based, ZFN, meganuclease, or Mega-TAL molecules and/or transgenes in cells (e.g., mammalian cells) and target tissues. Such methods can also be used to administer nucleic acids encoding CRISPR, TALEN, transposon-based, ZFN, meganuclease, or Mega-TAL molecules and/or transgenes to cells in vitro. In some examples, nucleic acids encoding CRISPR, TALEN, transposon-based, ZFN, meganuclease, or Mega-TAL molecules and/or transgenes can be administered for in vivo or ex vivo immunotherapy uses. Non-viral vector delivery systems can include DNA plasmids, naked nucleic acid, and nucleic acid complexed with a delivery vehicle such as a liposome or poloxamer. Viral vector delivery systems can include DNA and RNA viruses, which have either episomal or integrated genomes after delivery to the cell.

Methods of non-viral delivery of nucleic acids include electroporation, lipofection, nucleofection, gold nanoparticle delivery, microinjection, biolistics, virosomes, liposomes, immunoliposomes, polycation or lipid: nucleic acid conjugates, naked DNA, mRNA, artificial virions, and agent-enhanced uptake of DNA. Sonoporation using, e.g., the Sonitron 2000 system (Rich-Mar) can also be used for delivery of nucleic acids. Additional exemplary nucleic acid delivery systems include those provided by AMAXA® Biosystems (Cologne, Germany), Life Technologies (Frederick, Md.), MAXCYTE, Inc. (Rockville, Md.), BTX Molecular Delivery Systems (Holliston, Mass.) and Copernicus Therapeutics Inc. (see for example U.S. Pat. No. 6,008,336). Lipofection reagents are sold commercially (e.g., TRANSFECTAM® and LIPOFECTIN®). Delivery can be to cells (ex vivo administration) or target tissues (in vivo administration). Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis.

Vectors including viral and non-viral vectors containing nucleic acids encoding engineered CRISPR, TALEN, transposon-based, ZFN, meganuclease, or Mega-TAL molecules, transposon and/or transgenes can also be administered directly to an organism for transduction of cells in vivo. Alternatively, naked DNA or mRNA can be administered. Administration is by any of the routes normally used for introducing a molecule into ultimate contact with blood or tissue cells including, but not limited to, injection, infusion, topical application and electroporation. More than one route can be used to administer a particular composition. Pharmaceutically acceptable carriers are determined in part by the particular composition being administered, as well as by the particular method used to administer the composition.

In some cases, a vector encoding for an exogenous transgene can be shuttled to a cellular nuclease. For example, a vector can contain a nuclear localization sequence (NLS). An NLS can be from Simian Vacuolating Virus 40. A vector can also be shuttled by a protein or protein complex. In some cases, Cas9 can be used as a means to shuttle a minicircle vector. A Cas can comprise one or more NLS. In some cases, a vector can be pre-complexed with a Cas protein prior to electroporation. A Cas protein that can be used for shuttling can be a nuclease-deficient Cas9 (dCas9) protein. A Cas protein that can be used for shuttling can be a nuclease-competent Cas9. In some cases, Cas protein can be pre-mixed with a guide RNA and a vector or plasmid encoding an exogenous transgene.

Vectors can be delivered in vivo by administration to an individual subject, typically by systemic administration (e.g., intravenous, intraperitoneal, intramuscular, subdermal, or intracranial infusion) or topical application, as described below. Alternatively, vectors can be delivered to cells ex vivo, such as cells explanted from an individual subject (e.g., lymphocytes, T cells, bone marrow aspirates, tissue biopsy), followed by reimplantation of the cells into a subject, usually after selection for cells which have incorporated the vector. Prior to or after selection, the cells can be expanded.

A cell can be transfected with a mutant or chimeric adeno-associated viral vector encoding an exogenous transgene and an editing system comprising an RNase-H like domain containing protein. An AAV vector concentration can be from 0.5 nanograms to 50 micrograms. In some cases, the amount of nucleic acid (e.g., ssDNA, dsDNA, RNA) that can be introduced into the cell by electroporation can be varied to optimize transfection efficiency and/or cell viability. In some cases, less than about 100 picograms of nucleic acid can be added to each cell sample (e.g., one or more cells being electroporated). In some cases, at least about 100 picograms, at least about 200 picograms, at least about 300 picograms, at least about 400 picograms, at least about 500 picograms, at least about 600 picograms, at least about 700 picograms, at least about 800 picograms, at least about 900 picograms, at least about 1 microgram, at least about 1.5 micrograms, at least about 2 micrograms, at least about 2.5 micrograms, at least about 3 micrograms, at least about 3.5 micrograms, at least about 4 micrograms, at least about 4.5 micrograms, at least about 5 micrograms, at least about 5.5 micrograms, at least about 6 micrograms, at least about 6.5 micrograms, at least about 7 micrograms, at least about 7.5 micrograms, at least about 8 micrograms, at least about 8.5 micrograms, at least about 9 micrograms, at least about 9.5 micrograms, at least about 10 micrograms, at least about 11 micrograms, at least about 12 micrograms, at least about 13 micrograms, at least about 14 micrograms, at least about 15 micrograms, at least about 20 micrograms, at least about 25 micrograms, at least about 30 micrograms, at least about 35 micrograms, at least about 40 micrograms, at least about 45 micrograms, or at least about 50 micrograms, of nucleic acid can be added to each cell sample (e.g., one or more cells being electroporated). For example, 1 microgram of dsDNA can be added to each cell sample for electroporation. In some cases, the amount of nucleic acid (e.g., dsDNA) required for optimal transfection efficiency and/or cell viability can be specific to the cell type. In some cases, the amount of nucleic acid (e.g., dsDNA) used for each sample can directly correspond to the transfection efficiency and/or cell viability.

The transfection efficiency of cells with any of the nucleic acid delivery platforms described herein, for example, nucleofection or electroporation, can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9%.

Vectors, plasmids, and genomic editing systems described herein can be delivered by any suitable method, including transfection, electroporation, liposome delivery, membrane fusion techniques, high velocity DNA-coated pellets, viral infection and protoplast fusion. The methods used to construct any embodiment of this invention are known to those with skill in nucleic acid manipulation and include genetic engineering, recombinant engineering, and synthetic techniques. See, e.g., Sambrook et al, Molecular Cloning: A Laboratory Manual, Cold Spring Harbor Press, Cold Spring Harbor, N.Y. Electroporation using, for example, the Neon® Transfection System (ThermoFisher Scientific) or the AMARA® Nucleofector (AMARA® Biosystems) can also be used for delivery of nucleic acids into a cell. Electroporation parameters can be adjusted to optimize transfection efficiency and/or cell viability. Electroporation devices can have multiple electrical wave form pulse settings such as exponential decay, time constant and square wave. Every cell type has a unique optimal Field Strength (E) that is dependent on the pulse parameters applied (e.g., voltage, capacitance and resistance). Application of optimal field strength causes electropermeabilization through induction of transmembrane voltage, which allows nucleic acids to pass through the cell membrane. In some cases, the electroporation pulse voltage, the electroporation pulse width, number of pulses, cell density, and tip type can be adjusted to optimize transfection efficiency and/or cell viability.

In some cases, electroporation pulse voltage can be varied to optimize transfection efficiency and/or cell viability. In some cases, the electroporation voltage can be less than about 500 volts. In some cases, the electroporation voltage can be at least about 500 volts, at least about 600 volts, at least about 700 volts, at least about 800 volts, at least about 900 volts, at least about 1000 volts, at least about 1100 volts, at least about 1200 volts, at least about 1300 volts, at least about 1400 volts, at least about 1500 volts, at least about 1600 volts, at least about 1700 volts, at least about 1800 volts, at least about 1900 volts, at least about 2000 volts, at least about 2100 volts, at least about 2200 volts, at least about 2300 volts, at least about 2400 volts, at least about 2500 volts, at least about 2600 volts, at least about 2700 volts, at least about 2800 volts, at least about 2900 volts, or at least about 3000 volts. In some cases, the electroporation pulse voltage required for optimal transfection efficiency and/or cell viability can be specific to the cell type. For example, an electroporation voltage of 1900 volts can optimal (e.g., provide the highest viability and/or transfection efficiency) for macrophage cells. In another example, an electroporation voltage of about 1350 volts can optimal (e.g., provide the highest viability and/or transfection efficiency) for Jurkat cells or primary human cells such as T cells. In some cases, a range of electroporation voltages can be optimal for a given cell type. For example, an electroporation voltage between about 1000 volts and about 1300 volts can optimal (e.g., provide the highest viability and/or transfection efficiency) for human 578T cells.

In some cases, electroporation pulse width can be varied to optimize transfection efficiency and/or cell viability. In some cases, the electroporation pulse width can be less than about 5 milliseconds. In some cases, the electroporation width can be at least about 5 milliseconds, at least about 6 milliseconds, at least about 7 milliseconds, at least about 8 milliseconds, at least about 9 milliseconds, at least about 10 milliseconds, at least about 11 milliseconds, at least about 12 milliseconds, at least about 13 milliseconds, at least about 14 milliseconds, at least about 15 milliseconds, at least about 16 milliseconds, at least about 17 milliseconds, at least about 18 milliseconds, at least about 19 milliseconds, at least about 20 milliseconds, at least about 21 milliseconds, at least about 22 milliseconds, at least about 23 milliseconds, at least about 24 milliseconds, at least about 25 milliseconds, at least about 26 milliseconds, at least about 27 milliseconds, at least about 28 milliseconds, at least about 29 milliseconds, at least about 30 milliseconds, at least about 31 milliseconds, at least about 32 milliseconds, at least about 33 milliseconds, at least about 34 milliseconds, at least about 35 milliseconds, at least about 36 milliseconds, at least about 37 milliseconds, at least about 38 milliseconds, at least about 39 milliseconds, at least about 40 milliseconds, at least about 41 milliseconds, at least about 42 milliseconds, at least about 43 milliseconds, at least about 44 milliseconds, at least about 45 milliseconds, at least about 46 milliseconds, at least about 47 milliseconds, at least about 48 milliseconds, at least about 49 milliseconds, or at least about 50 milliseconds. In some cases, the electroporation pulse width required for optimal transfection efficiency and/or cell viability can be specific to the cell type. For example, an electroporation pulse width of 30 milliseconds can optimal (e.g., provide the highest viability and/or transfection efficiency) for macrophage cells. In another example, an electroporation width of about 10 milliseconds can optimal (e.g., provide the highest viability and/or transfection efficiency) for Jurkat cells. In some cases, a range of electroporation widths can be optimal for a given cell type. For example, an electroporation width between about 20 milliseconds and about 30 milliseconds can optimal (e.g., provide the highest viability and/or transfection efficiency) for human 578T cells.

In some cases, the number of electroporation pulses can be varied to optimize transfection efficiency and/or cell viability. In some cases, electroporation can comprise a single pulse. In some cases, electroporation can comprise more than one pulse. In some cases, electroporation can comprise 2 pulses, 3 pulses, 4 pulses, 5 pulses 6 pulses, 7 pulses, 8 pulses, 9 pulses, or 10 or more pulses. In some cases, the number of electroporation pulses required for optimal transfection efficiency and/or cell viability can be specific to the cell type. For example, electroporation with a single pulse can be optimal (e.g., provide the highest viability and/or transfection efficiency) for macrophage cells. In another example, electroporation with a 3 pulses can be optimal (e.g., provide the highest viability and/or transfection efficiency) for primary cells. In some cases, a range of electroporation widths can be optimal for a given cell type. For example, electroporation with between about 1 to about 3 pulses can be optimal (e.g., provide the highest viability and/or transfection efficiency) for human cells.

In some cases, the starting cell density for electroporation can be varied to optimize transfection efficiency and/or cell viability. In some cases, the starting cell density for electroporation can be less than about $1 \times 10^5$ cells. In some cases, the starting cell density for electroporation can be at least about $1 \times 10^5$ cells, at least about $2 \times 10^5$ cells, at least about $3 \times 10^5$ cells, at least about $4 \times 10^5$ cells, at least about $5 \times 10^5$ cells, at least about $6 \times 10^5$ cells, at least about $7 \times 10^5$ cells, at least about $8 \times 10^5$ cells, at least about $9 \times 10^5$ cells, at least about $1 \times 10^6$ cells, at least about $1.5 \times 10^6$ cells, at least about $2 \times 10^6$ cells, at least about $2.5 \times 10^6$ cells, at least about $3 \times 10^6$ cells, at least about $3.5 \times 10^6$ cells, at least about $4 \times 10^6$ cells, at least about $4.5 \times 10^6$ cells, at least about $5 \times 10^6$ cells, at least about $5.5 \times 10^6$ cells, at least about $6 \times 10^6$ cells, at least about $6.5 \times 10^6$ cells, at least about $7 \times 10^6$ cells, at least about $7.5 \times 10^6$ cells, at least about $8 \times 10^6$ cells, at least about $8.5 \times 10^6$ cells, at least about $9 \times 10^6$ cells, at least about $9.5 \times 10^6$ cells, at least about $1 \times 10^7$ cells, at least about $1.2 \times 10^7$ cells, at least about $1.4 \times 10^7$ cells, at least about $1.6 \times 10^7$ cells, at least about $1.8 \times 10^7$ cells, at least about $2 \times 10^7$ cells, at least about $2.2 \times 10^7$ cells, at least about $2.4 \times 10^7$ cells, at least about $2.6 \times 10^7$ cells, at least about $2.8 \times 10^7$ cells, at least about $3 \times 10^7$ cells, at least about $3.2 \times 10^7$ cells, at least about $3.4 \times 10^7$ cells, at least about $3.6 \times 10^7$ cells, at least about $3.8 \times 10^7$ cells, at least about $4 \times 10^7$ cells, at least about $4.2 \times 10^7$ cells, at least about $4.4 \times 10^7$ cells, at least about $4.6 \times 10^7$ cells, at least about $4.8 \times 10^7$ cells, or at least about $5 \times 10^7$ cells. In some cases, the starting cell density for electroporation required for optimal transfection efficiency and/or cell viability can be specific to the cell type. For example, a starting cell density for electroporation of $1.5 \times 10^6$ cells can optimal (e.g., provide the highest viability and/or transfection efficiency) for macrophage cells. In another example, a starting cell density for electroporation of $5 \times 10^6$ cells can optimal (e.g., provide the highest viability and/or transfection efficiency) for human cells. In some cases, a range of starting cell densities for electroporation can be optimal for a given cell type. For example, a starting cell density for electroporation between of $5.6 \times 10^6$ and $5 \times 10^7$ cells can optimal (e.g., provide the highest viability and/or transfection efficiency) for human cells such as T cells.

In some cases, a guiding polynucleic acid and nuclease can be introduced into cells as a complex. A complex can be a ribonuclear protein complex (RNP). Introduction of an RNP complex can be timed. In some cases, a cell can be synchronized with other cells at G1, S, and/or M phases of the cell cycle prior to introduction of a guiding polynucleic acid and nuclease. In some cases, an RNP complex can be delivered at a cell phase such that HDR, MMEJ, or NHEJ can be enhanced. In some cases an RNP complex can facilitate homology directed repair.

Non-homologous end joining (NHEJ) and Homology-directed repair (HDR) can be quantified using a variety of methods.

In some cases, a percent of NHEJ, HDR, or a combination of both can be determined by co-delivering the gene editing molecules, for example a guiding polynucleic acid and an RNase H like domain containing polypeptide, with a donor DNA template that encodes a promoterless GFP into cells. After about 72 hrs., flow cytometry can be performed to quantify the total cell number ($N_{Total}$), Total, GFP-positive cell number ($N_{GFP+}$), and GFP-negative cell number ($N_{GFP-}$). Among the GFP negative cells, next-generation sequencing can be performed to identify cells without mutations ($N_{GFP-}^0$), and with mutations ($N_{GFP-}^1$). HDR efficiency can be calculated as $N_{GFP+}/N_{Total} \times 100\%$, and NHEJ efficiency will be calculated as $N_{GFP-}^1/N_{Total} \times 100\%$.

Figure 31:
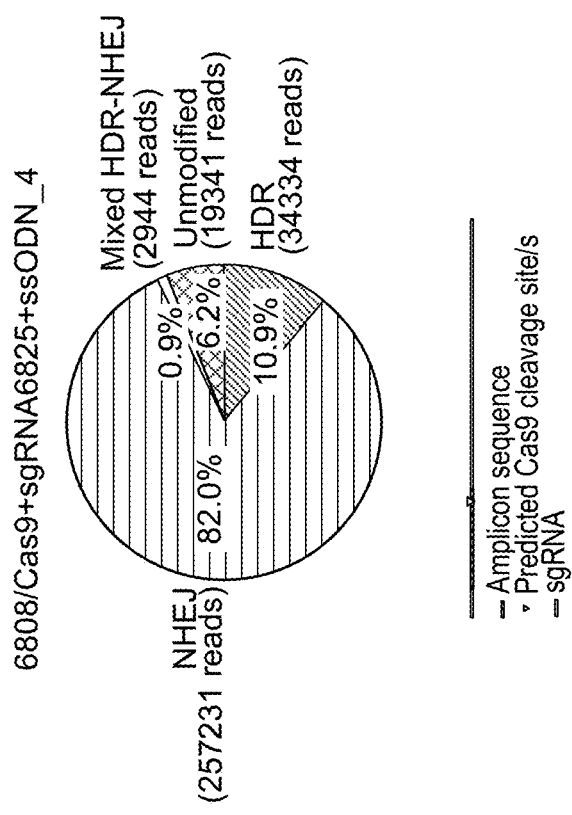
FIG. 31 shows the results of a sequencing reaction performed on 6808 cells treated with Cas9, sgRNA6825 and ssODN_4 donor.
Figure 32A:
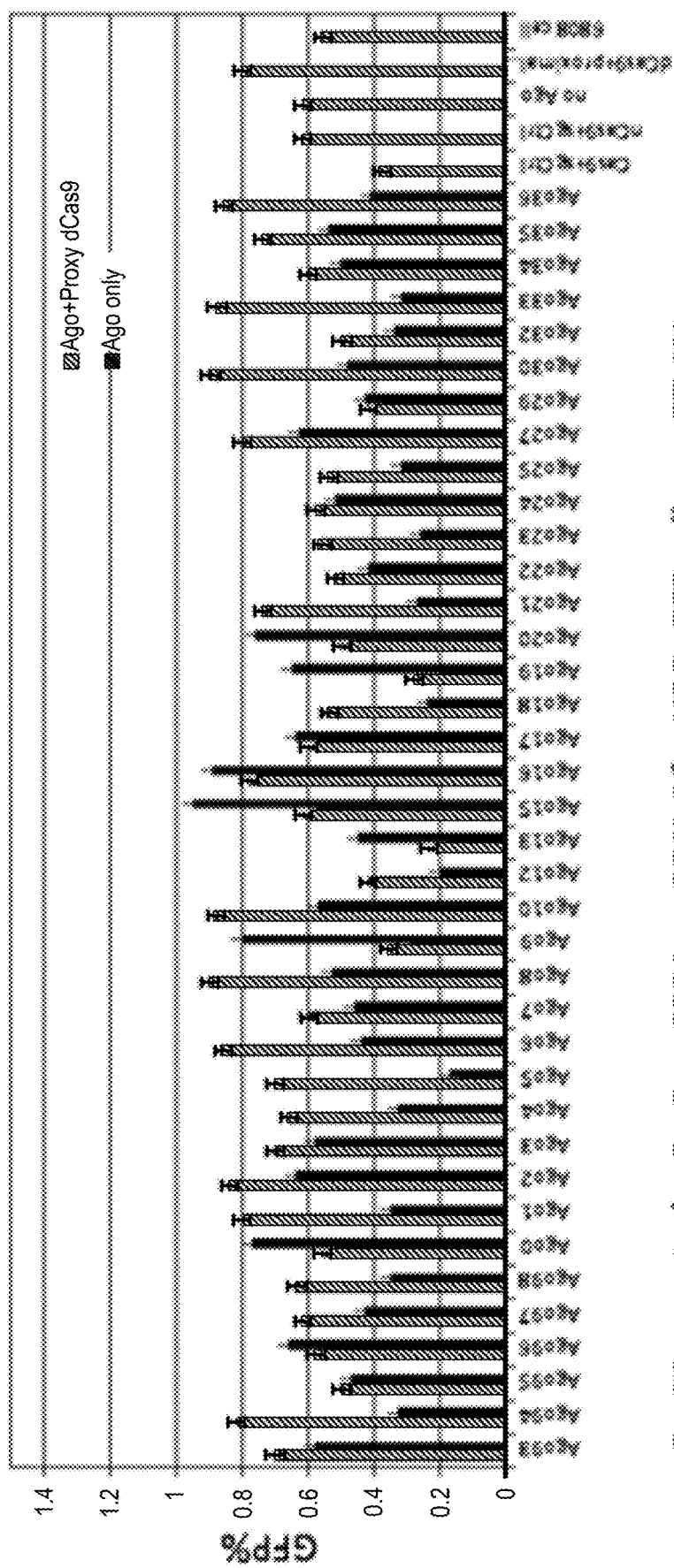
FIG. 32A and FIG. 32B show the results of the split fluorescence 6808 cell assay for 38 and 44 different Ago proteins respectively.
Figure 32B:
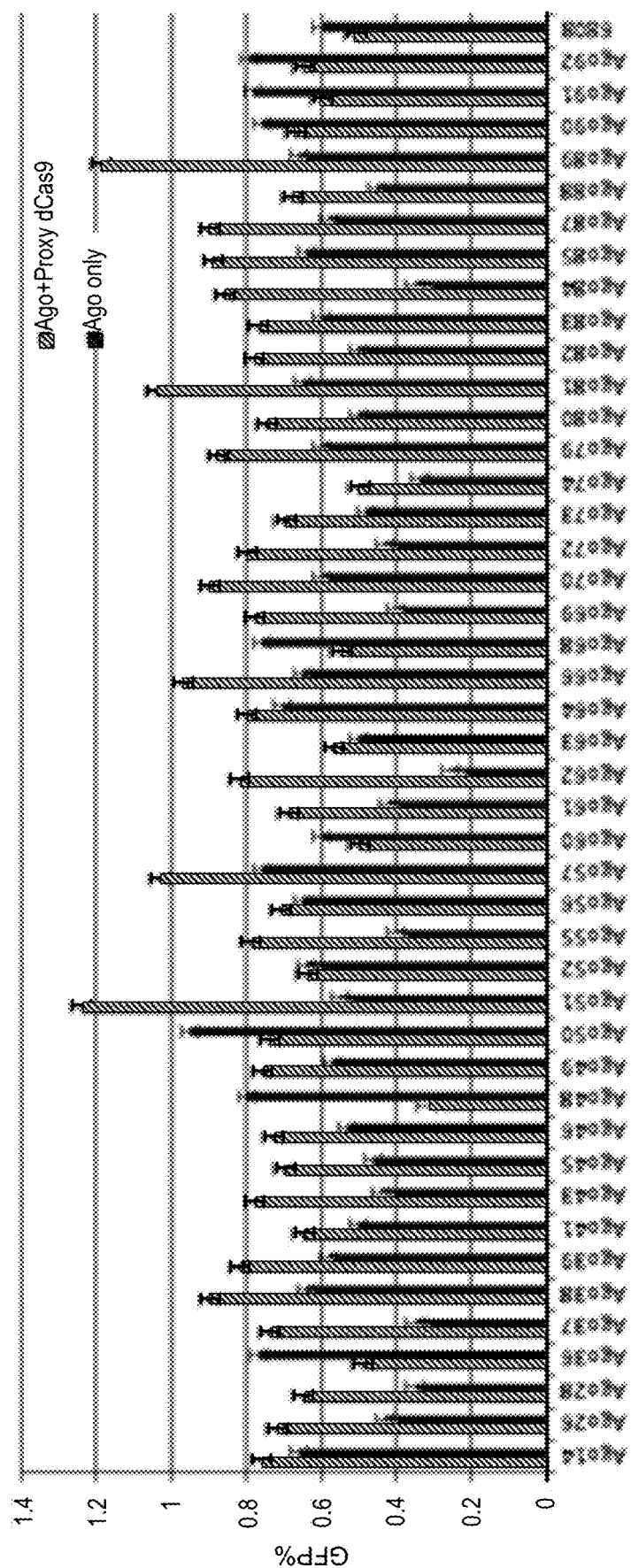

In some cases, activity of a DNA editing system may be assayed using a cell expressing a reporter protein or containing a reporter gene. For example, a reporter protein may be engineered to contain an obstruction, such as a stop codon, a frameshift mutation, a spacer, a linker, or a transcriptional terminator; the DNA editing system may then be used to remove the obstruction and the resultant functional reporter protein may be detected. In some cases, the obstruction may be designed such that a specific sequence modification is required to restore functionality of the reporter protein. In other cases, the obstruction may be designed such that any insertion or deletion which results in a frame shift of one or two bases may be sufficient to restore functionality of the reporter protein. Examples of reporter proteins include colorimetric enzymes, metabolic enzymes, fluorescent proteins, enzymes and transporters associated with antibiotic resistance, and luminescent enzymes. Examples of such reporter proteins include β-galactosidase, Chloramphenicol acetyltransferase, Green fluorescent protein, Red fluorescent protein, luciferase, and renilla. Different detection methods may be used for different reporter proteins. For example, the reporter protein may affect cell viability, cell growth, fluorescence, luminescence, or expression of a detectable product. In some cases, the reporter protein may be detected using a colorimetric assay. In some cases, the reporter protein may be a fluorescent protein, and DNA editing may be assayed by measuring the degree of fluorescence in treated cells, or the number of treated cells with at least a threshold level of fluorescence. In some cases, transcript levels of a reporter gene may be assessed. In other cases, a reporter gene may be assessed by sequencing. In some cases, an assay for measuring DNA editing may use a split fluorescence protein system, such as the self-complementing split $GFP_{1-10/11}$ systems, in which two fragments ($G_{1-10}$ and $G_{11}$) of the GFP protein which can associate by themselves to form a functional GFP signal are linked using a frameshifting linker. Insertions or deletions within the frameshifting linker can restore the frame of the $G_{11}$ fragment allowing the two fragments to form a functional GFP signal. An example of such an assay is shown in Example 12, and FIGS. 18-25 and FIG. 27-32. As seen in FIG. 32A and FIG. 32B Ago51 and Ago89 both resulted in ~1.2% of cells showing GFP fluorescence, a level 2 fold higher than seen in the no Ago control condition (0.6%), indicating successful DNA editing at a level of double that seen at baseline. In some cases, Ago proteins as described herein may result in at least about 1%, 1.1%, 1.2%, 1.3%, 1.4%, 1.5%, 1.6%, 1.7%, 1.8%, 1.9%, 2%, 2.5%, 3%, 4%, 5%, 6%, 7%, 8%, 9%, 10%, 15%, 20%, 25%, 30%, 35%, 40%, 45%, 50%, 60%, 70%, 80%, 90%, 95%, 97%, 98%, or 99% of cells exhibiting restored activity of a reporter protein. In some cases, Ago proteins as described herein may result in at least about 1% to 99%, 1% to 10%, 1% to 5%, 1% to 2%, 5% to 50%, 10% to 60%, 10% to 50%, 30% to 70%, or 50% to 80% of cells exhibiting restored activity of a reporter protein. In some cases, Ago proteins as described herein may result in at least about a 1.5 fold, 2 fold, 3 fold, 4 fold, 5 fold, 6 fold, 7 fold, 8 fold, 9 fold, 10 fold, 15 fold, 20 fold, 25 fold, 30 fold, 40 fold, 50 fold, 60 fold, 70 fold, 80 fold, 90 fold, or 100 fold increase in the percentage of cells with restored activity of a reporter as compared to baseline. In some cases, Ago proteins as described herein may result in at least about a 1.2 fold to 10 fold, 1.5 fold to 10 fold, 2 fold to 10 fold, 2 fold to 5 fold, 2 fold to 20 fold, 3 fold to 5 fold, 4 fold to 10 fold, 5 fold to 20 fold, 10 fold to 100 fold, 10 fold to 50 fold or 1.2 fold to 100 fold increase in the percentage of cells with restored activity of a reporter as compared to baseline.

The percent occurrence of a genomic break repair utilizing HDR over NHEJ or MMEJ can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9% of cells that are contacted with a genomic editing system comprising an RNase-H like domain. The percent occurrence of a genomic break repair utilizing NHEJ over HDR or MMEJ can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9% of cells that are contacted with a genomic editing system comprising an RNase-H like domain. The percent occurrence of a genomic break repair utilizing MMEJ over HDR or NHEJ can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9% of cells that are contacted with a genomic editing system comprising an RNase-H like domain.

Integration of an exogenous polynucleic acid, such as a TCR, can be measured using any technique. For example, integration can be measured by flow cytometry, surveyor nuclease assay, tracking of indels by decomposition (TIDE), junction PCR, or any combination thereof. In other cases, transgene integration can be measured by PCR. A TIDE analysis can also be performed on engineered cells. Ex vivo cell transfection can also be used for diagnostics, research, or for gene therapy (e.g., via re-infusion of the transfected cells into the host organism). In some cases, cells are isolated from the subject organism, transfected with a nucleic acid (e.g., gene or cDNA), and re-infused back into the subject organism (e.g., subject).

The amount of RHDC polypeptide-containing modified cells that can be necessary to be therapeutically effective in a subject can vary depending on the viability of the cells, and the efficiency with which the cells have been genetically modified (e.g., the efficiency with which a transgene has been integrated into one or more cells). In some cases, the product (e.g., multiplication) of the viability of cells post genetic modification and the efficiency of integration of a transgene can correspond to the therapeutic aliquot of cells available for administration to a subject. In some cases, an increase in the viability of cells post genetic modification can correspond to a decrease in the amount of cells that are necessary for administration to be therapeutically effective in a subject. In some cases, an increase in the efficiency with which a transgene has been integrated into one or more cells can correspond to a decrease in the amount of cells that are necessary for administration to be therapeutically effective in a subject. In some cases, determining an amount of cells that are necessary to be therapeutically effective can comprise determining a function corresponding to a change in the viability of cells over time. In some cases, determining an amount of cells that are necessary to be therapeutically effective can comprise determining a function corresponding to a change in the efficiency with which a transgene can be integrated into one or more cells with respect to time dependent variables (e.g., cell culture time, electroporation time, cell stimulation time).

As described herein, viral particles, such as AAV, can be used to deliver a viral vector comprising a gene of interest or a transgene, such as an exogenous TCR, into a cell ex vivo or in vivo. In some embodiments, a mutated or chimeric adeno-associated viral vector as disclosed herein can be measured as pfu (plaque forming units). In some cases, the pfu of recombinant virus or mutated or chimeric adeno-associated viral vector of the compositions and methods of the disclosure can be about $10^8$ to about $5 \times 10^{10}$ pfu. In some cases, recombinant viruses of this disclosure are at least about $1 \times 10^8$, $2 \times 10^8$, $3 \times 10^8$, $4 \times 10^8$, $5 \times 10^8$, $6 \times 10^8$, $7 \times 10^8$, $8 \times 10^8$, $9 \times 10^8$, $1 \times 10^9$, $2 \times 10^9$, $3 \times 10^9$, $4 \times 10^9$, $5 \times 10^9$, $6 \times 10^9$, $7 \times 10^9$, $8 \times 10^9$, $9 \times 10^9$, $1 \times 10^{10}$, $2 \times 10^{10}$, $3 \times 10^{10}$, $4 \times 10^{10}$, and $5 \times 10^{10}$ pfu. In some cases, recombinant viruses of this disclosure are at most about $1 \times 10^8$, $2 \times 10^8$, $3 \times 10^8$, $4 \times 10^8$, $5 \times 10^8$, $6 \times 10^8$, $7 \times 10^8$, $8 \times 10^8$, $9 \times 10^8$, $1 \times 10^9$, $2 \times 10^9$, $3 \times 10^9$, $4 \times 10^9$, $5 \times 10^9$, $6 \times 10^9$, $7 \times 10^9$, $8 \times 10^9$, $9 \times 10^9$, $1 \times 10^{10}$, $2 \times 10^{10}$, $3 \times 10^{10}$, $4 \times 10^{10}$, and $5 \times 10^{10}$ pfu. In some aspects, a mutated or chimeric adeno-associated viral vector of the disclosure can be measured as vector genomes. In some cases, recombinant viruses of this disclosure are $1 \times 10^{10}$ to $3 \times 10^{12}$ vector genomes, or $1 \times 10^9$ to $3 \times 10^{13}$ vector genomes, or $1 \times 10^8$ to $3 \times 10^{14}$ vector genomes, or at least about $1 \times 10^1$, $1 \times 10^2$, $1 \times 10^3$, $1 \times 10^4$, $1 \times 10^5$, $1 \times 10^6$, $1 \times 10^7$, $1 \times 10^8$, $1 \times 10^9$, $1 \times 10^{10}$, $1 \times 10^{11}$, $1 \times 10^{12}$, $1 \times 10^{13}$, $1 \times 10^{14}$, $1 \times 10^{15}$, $1 \times 10^{16}$, $1 \times 10^{17}$, and $1 \times 10^{18}$ vector genomes, or are $1 \times 10^8$ to $3 \times 10^{14}$ vector genomes, or are at most about $1 \times 10^1$, $1 \times 10^2$, $1 \times 10^3$, $1 \times 10^4$, $1 \times 10^5$, $1 \times 10^6$, $1 \times 10^7$, $1 \times 10^8$, $1 \times 10^9$, $1 \times 10^{10}$, $1 \times 10^{11}$, $1 \times 10^{12}$, $1 \times 10^{13}$, $1 \times 10^{14}$, $1 \times 10^{15}$, $1 \times 10^{16}$, $1 \times 10^{17}$, and $1 \times 10^{18}$ vector genomes.

In some cases, a mutated or chimeric adeno-associated viral vector of the disclosure can be measured using multiplicity of infection (MOI). In some cases, MOI can refer to the ratio, or multiple of vector or viral genomes to the cells to which the nucleic can be delivered. In some cases, the MOI can be $1 \times 10^6$ GC/mL. In some cases, the MOI can be $1 \times 10^5$ GC/mL to $1 \times 10^7$ GC/mL. In some cases, the MOI can be $1 \times 10^4$ GC/mL to $1 \times 10^8$ GC/mL. In some cases, recombinant viruses of the disclosure are at least about $1 \times 10^1$ GC/mL, $1 \times 10^2$ GC/mL, $1 \times 10^3$ GC/mL, $1 \times 10^4$ GC/mL, $1 \times 10^5$ GC/mL, $1 \times 10^6$ GC/mL, $1 \times 10^7$ GC/mL, $1 \times 10^8$ GC/mL, $1 \times 10^9$ GC/mL, $1 \times 10^{10}$ GC/mL, $1 \times 10^{11}$ GC/mL, $1 \times 10^{12}$ GC/mL, $1 \times 10^{13}$ GC/mL, $1 \times 10^{14}$ GC/mL, $1 \times 10^{15}$ GC/mL, $1 \times 10^{16}$ GC/mL, $1 \times 10^{17}$ GC/mL, and $1 \times 10^{18}$ GC/mL MOI. In some cases, a mutated or chimeric adeno-associated viruses of this disclosure are from about $1 \times 10^8$ GC/mL to about $3 \times 10^{14}$ GC/mL MOI, or are at most about $1 \times 10^1$ GC/mL, $1 \times 10^2$ GC/mL, $1 \times 10^3$ GC/mL, $1 \times 10^4$ GC/mL, $1 \times 10^5$ GC/mL, $1 \times 10^6$ GC/mL, $1 \times 10^7$ GC/mL, $1 \times 10^8$ GC/mL, $1 \times 10^9$ GC/mL, $1 \times 10^{10}$ GC/mL, $1 \times 10^{11}$ GC/mL, $1 \times 10^{12}$ GC/mL, $1 \times 10^{13}$ GC/mL, $1 \times 10^{14}$ GC/mL, $1 \times 10^{15}$ GC/mL, $1 \times 10^{16}$ GC/mL, $1 \times 10^{17}$ GC/mL, and $1 \times 10^{18}$ GC/mL MOI.

In some aspects, a non-viral vector or nucleic acid can be delivered without the use of a mutated or chimeric adeno-associated viral vector and can be measured according to the quantity of nucleic acid. Generally, any suitable amount of nucleic acid can be used with the compositions and methods of this disclosure. In some cases, nucleic acid can be at least about 1 pg, 10 pg, 100 pg, 1 pg, 10 pg, 100 pg, 200 pg, 300 pg, 400 pg, 500 pg, 600 pg, 700 pg, 800 pg, 900 pg, 1 µg, 10 µg, 100 µg, 200 µg, 300 µg, 400 µg, 500 µg, 600 µg, 700 µg, 800 µg, 900 µg, 1 ng, 10 ng, 100 ng, 200 ng, 300 ng, 400 ng, 500 ng, 600 ng, 700 ng, 800 ng, 900 ng, 1 mg, 10 mg, 100 mg, 200 mg, 300 mg, 400 mg, 500 mg, 600 mg, 700 mg, 800 mg, 900 mg, 1 g, 2 g, 3 g, 4 g, or 5 g. In some cases, nucleic acid can be at most about 1 pg, 10 pg, 100 pg, 1 pg, 10 pg, 100 pg, 200 pg, 300 pg, 400 pg, 500 pg, 600 pg, 700 pg, 800 pg, 900 pg, 1 µg, 10 µg, 100 µg, 200 µg, 300 µg, 400 µg, 500 µg, 600 µg, 700 µg, 800 µg, 900 µg, 1 ng, 10 ng, 100 ng, 200 ng, 300 ng, 400 ng, 500 ng, 600 ng, 700 ng, 800 ng, 900 ng, 1 mg, 10 mg, 100 mg, 200 mg, 300 mg, 400 mg, 500 mg, 600 mg, 700 mg, 800 mg, 900 mg, 1 g, 2 g, 3 g, 4 g, or 5 g.

Cells (e.g., engineered cells or engineered primary Cells) before, after, and/or during transplantation can be functional. For example, transplanted cells can be functional for at least or at least about 1, 2, 3, 4, 5, 6, 7, 8, 9, 10, 11, 12, 13, 14, 15, 16, 17, 18, 19, 20, 21, 22, 23, 24, 25, 6, 27, 28, 29, 30, 40, 50, 60, 70, 80, 90, or 100 days after transplantation. Transplanted cells can be functional for at least or at least about 1, 2, 3, 4, 5, 6, 7, 8, 9, 10, 11, or 12 months after transplantation. Transplanted cells can be functional for at least or at least about 1, 2, 3, 4, 5, 6, 7, 8, 9, 10, 15, 20, 25, or 30 years after transplantation. In some cases, transplanted cells can be functional for up to the lifetime of a recipient.

Further, transplanted cells can function at 100% of its normal intended operation. Transplanted cells can also function 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% of its normal intended operation.

Transplanted cells can also function over 100% of its normal intended operation. For example, transplanted cells can function 110, 120, 130, 140, 150, 160, 170, 180, 190, 200, 250, 300, 400, 500, 600, 700, 800, 900, 1000 or more % of its normal intended operation.

One or more cytokines can be introduced with cells of the invention. Cytokines can be utilized to boost cytotoxic T lymphocytes (including adoptively transferred tumor-specific cytotoxic T lymphocytes) to expand within a tumor microenvironment. In some cases, IL-2 can be used to facilitate expansion of the cells described herein. Cytokines such as IL-15 can also be employed. Other relevant cytokines in the field of immunotherapy can also be utilized, such as IL-2, IL-7, IL-12, IL-15, IL-21, or any combination thereof.

In some cases, IL-2 can be administered beginning within 24 hours of cell infusion and continuing for up to about 4 days (maximum 12 doses). In some cases, IL-2 can be administered for up to about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 days after an initial administration. Doses of IL-2 can be administered every eight hours. In some cases, IL-2 can be administered from about every 1, 2, 3, 4, 5, 6, 7, 8, 9, 10, 11, 12, 13, 14, 15, 16, 17, 18, 19, 20, 21, 22, 23, 24 hours after an initial administration. In some cases, IL-2 dosing can be stopped if toxicities are detected. In some cases, doses can be delayed or stopped if subjects reach Grade 3 or 4 toxicity due to aldesleukin except for the reversible Grade 3 toxicities common to Aldesleukin such as diarrhea, nausea, vomiting, hypotension, skin changes, anorexia, mucositis, dysphagia, or constitutional symptoms and laboratory changes. In some cases, if these toxicities can be easily reversed within 24 hours by supportive measures, then additional doses can be given. In addition, dosing can be held or stopped at the discretion of a treating physician.

Pharmaceutical Compositions and Formulations

The compositions described throughout can be formulation into a pharmaceutical medicament and be used to treat a human or mammal, in need thereof, diagnosed with a disease, e.g., cancer. These medicaments can be co-administered with one or more T cells (e.g., engineered T cells) to a human or mammal, together with one or more chemotherapeutic agent or chemotherapeutic compound. The application also provides materials and methods comprising modified polynucleotides and methods of using such polynucleotides for ameliorating one or more symptoms or complications associated with human genetic diseases.

A chemotherapeutic agent can be a chemical compound useful in the treatment of cancer. The chemotherapeutic cancer agents that can be used in combination with the disclosed T cell include, but are not limited to, mitotic inhibitors (vinca alkaloids). These include vincristine, vinblastine, vindesine and Navelbine™ (vinorelbine, 5'-noranhydroblastine). In yet other cases, chemotherapeutic cancer agents include topoisomerase I inhibitors, such as camptothecin compounds. As used herein, "camptothecin compounds" include Camptosar™ (irinotecan HCL), Hycamtin™ (topotecan HCL) and other compounds derived from camptothecin and its analogues. Another category of chemotherapeutic cancer agents that can be used in the methods and compositions disclosed herein can be podophyllotoxin derivatives, such as etoposide, teniposide and mitopodozide. The present disclosure further encompasses other chemotherapeutic cancer agents known as alkylating agents, which alkylate the genetic material in tumor cells. These include without limitation cisplatin, cyclophosphamide, nitrogen mustard, trimethylene thiophosphoramide, carmustine, busulfan, chlorambucil, belustine, uracil mustard, chlomaphazin, and dacarbazine. The disclosure encompasses antimetabolites as chemotherapeutic agents. Examples of these types of agents include cytosine arabinoside, fluorouracil, methotrexate, mercaptopurine, azathioprime, and procarbazine. An additional category of chemotherapeutic cancer agents that can be used in the methods and compositions disclosed herein includes antibiotics. Examples include without limitation doxorubicin, bleomycin, dactinomycin, daunorubicin, mithramycin, mitomycin, mytomycin C, and daunomycin. There are numerous liposomal formulations commercially available for these compounds. The present disclosure further encompasses other chemotherapeutic cancer agents including without limitation anti-tumor antibodies, dacarbazine, azacytidine, amsacrine, melphalan, ifosfamide and mitoxantrone.

A patient may be infused with as many cells that can be generated for them. In some cases, cells that are infused into a patient are not all engineered. In some cases, a subject may receive a percentage of engineered cells in a total population of cells that can be introduced. For example, at least 90% of cells that can be introduced into a patient can be engineered. In other instances, at least 40% of cells that are introduced into a patient can be engineered. For example, a patient may receive any number of engineered cells, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% of the total introduced population.

The disclosed cell herein can be administered in combination with other anti-tumor agents, including cytotoxic/ antineoplastic agents and anti-angiogenic agents. Cytotoxic/ anti-neoplastic agents can be defined as agents who attack and kill cancer cells.

Anti-angiogenic agents can also be used. Suitable anti-angiogenic agents for use in the disclosed methods and compositions include anti-VEGF antibodies, including humanized and chimeric antibodies, anti-VEGF aptamers and antisense oligonucleotides. Other inhibitors of angiogenesis include angiostatin, endostatin, interferons, interleukin 1 (including α and β) interleukin 12, retinoic acid, and tissue inhibitors of metalloproteinase-1 and -2. (TIMP-1 and -2) Small molecules, including topoisomerases such as razoxane, a topoisomerase II inhibitor with anti-angiogenic activity, can also be used.

In some cases, for example, in the compositions, formulations and methods of treatment, the unit dosage of the composition or formulation administered can be 5, 10, 15, 20, 25, 30, 35, 40, 45, 50, 55, 60, 65, 70, 75, 80, 85, 90, 95 or 100 mg. In some cases, the total amount of the composition or formulation administered can be 0.1, 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20, 25, 30, 40, 50, 60, 70, 80, 90, or 100 g.

In some cases, the present invention provides a pharmaceutical composition comprising a cell can be administered either alone or together with a pharmaceutically acceptable carrier or excipient, by any routes, and such administration can be carried out in both single and multiple dosages. More particularly, the pharmaceutical composition can be combined with various pharmaceutically acceptable inert carriers in the form of tablets, capsules, lozenges, troches, hand candies, powders, sprays, aqueous suspensions, injectable solutions, elixirs, syrups, and the like. Such carriers include solid diluents or fillers, sterile aqueous media and various non-toxic organic solvents, etc. Moreover, such oral pharmaceutical formulations can be suitably sweetened and/or flavored by means of various agents of the type commonly employed for such purposes.

In some cases a carrier can be water, saline, ethanol, glycerol, lactose, sucrose, calcium phosphate, gelatin, dextran, agar, pectin, peanut oil, sesame oil, etc., a diluent, a pharmaceutically-acceptable carrier (e.g., phosphate-buffered saline), a pharmaceutically-acceptable excipient, an adjuvant to enhance antigenicity, an immunostimulatory compound or molecule, and/or other compounds known in the art. The adjuvant herein may contain a suspension of minerals (alum, aluminum hydroxide, aluminum phosphate) on which antigen is adsorbed; or water-in-oil emulsion in which antigen solution is emulsified in oil (MF-59, Freund's incomplete adjuvant), sometimes with the inclusion of killed mycobacteria (Freund's complete adjuvant) to further enhance antigenicity (inhibits degradation of antigen and/or causes influx of macrophages). Adjuvants also include immunostimulatory molecules, such as cytokines, costimulatory molecules, and for example, immunostimulatory DNA or RNA molecules, such as CpG oligonucleotides. Such a dosage formulation is readily ascertainable by one skilled in the art. A dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenyl ethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in Remington's pharmaceutical sciences (Mack Pub. Co., N.J. 1991) which is incorporated by reference herein.

Cells can be extracted from a human as described herein. Cells can be genetically altered ex vivo and used accordingly. These cells can be used for cell-based therapies. These cells can be used to treat disease in a recipient (e.g., a human) For example, these cells can be used to treat cancer.

Described herein is a method of treating a disease (e.g., cancer) in a recipient comprising transplanting to the recipient one or more cells (including organs and/or tissues) comprising engineered cells. Cells prepared by intracellular genomic transplant can be used to treat cancer.

Described herein is a method of treating a disease (e.g., cancer) in a recipient comprising transplanting to the recipient one or more Argonaute modified cells (including organs and/or tissues). Generally, modified cells described herein can be expanded by contact with a surface having attached thereto an agent that can stimulate a CD3 TCR complex associated signal and a ligand that can stimulate a co-stimulatory molecule on the surface of the T cells. In particular, cell populations can be stimulated in vitro such as by contact with an anti-CD3 antibody or antigen-binding fragment thereof, or an anti-CD2 antibody immobilized on a surface, or by contact with a protein kinase C activator (e.g., bryostatin) sometimes in conjunction with a calcium ionophore. For co-stimulation of an accessory molecule on the surface of modified cells, a ligand that binds the accessory molecule can be used. For example, a population of cells can be contacted with an anti-CD3 antibody and an anti-CD28 antibody, under conditions that can stimulate proliferation of the T cells. In some cases, 4-1BB can be used to stimulate cells. For example, cells can be stimulated with 4-1BB and IL-21 or another cytokine. In some cases $5\times10^{10}$ cells will be administered to a subject. In other cases, $5\times10^{11}$ cells will be administered to a subject.

In some embodiments, about $5\times10^{10}$ cells are administered to a subject. In some embodiments, about $5\times10^{10}$ cells represent the median amount of cells administered to a subject. In some embodiments, about $5\times10^{10}$ cells are necessary to affect a therapeutic response in a subject. In some embodiments, at least about at least about $1\times10^7$ cells, at least about $2\times10^7$ cells, at least about $3\times10^7$ cells, at least about $4\times10^7$ cells, at least about $5\times10^7$ cells, at least about $6\times10^7$ cells, at least about $6\times10^7$ cells, at least about $8\times10^7$ cells, at least about $9\times10^7$ cells, at least about $1\times10^8$ cells, at least about $2\times10^8$ cells, at least about $3\times10^8$ cells, at least about $4\times10^8$ cells, at least about $5\times10^8$ cells, at least about $6\times10^8$ cells, at least about $6\times10^8$ cells, at least about $8\times10^8$ cells, at least about $9\times10^8$ cells, at least about $1\times10^9$ cells, at least about $2\times10^9$ cells, at least about $3\times10^9$ cells, at least about $4\times10^9$ cells, at least about $5\times10^9$ cells, at least about $6\times10^9$ cells, at least about $6\times10^9$ cells, at least about $8\times10^9$ cells, at least about $9\times10^9$ cells, at least about $1\times10^{10}$ cells, at least about $2\times10^{10}$ cells, at least about $3\times10^{10}$ cells, at least about $4\times10^{10}$ cells, at least about $5\times10^{10}$ cells, at least about $6\times10^{10}$ cells, at least about $6\times10^{10}$ cells, at least about $8\times10^{10}$ cells, at least about $9\times10^{10}$ cells, at least about $1\times10^{11}$ cells, at least about $2\times10^{11}$ cells, at least about $3\times10^{11}$ cells, at least about $4\times10^{11}$ cells, at least about $5\times10^{11}$ cells, at least about $6\times10^{11}$ cells, at least about $6\times10^{11}$ cells, at least about $8\times10^{11}$ cells, at least about $9\times10^{11}$ cells, or at least about $1\times10^{12}$ cells. For example, about $5\times10^{10}$ cells can be administered to a subject. In another example, starting with $3\times10^6$ cells, the cells can be expanded to about $5\times10^{10}$ cells and administered to a subject. In some cases, cells are expanded to sufficient numbers for therapy. For example, $5\times10^7$ cells can undergo rapid expansion to generate sufficient numbers for therapeutic use. In some cases, sufficient numbers for therapeutic use can be $5\times10^{10}$. Any number of cells can be infused for therapeutic use. For example, a subject can be infused with a number of cells between $1\times10^6$ to $5\times10^{12}$ inclusive. A subject can be infused with as many cells that can be generated for them. In some cases, cells that are infused into a subject are not all engineered. For example, at least 90% of cells that are infused into a subject can be engineered. In other instances, at least 40% of cells that are infused into a subject can be engineered.

In some embodiments, a method of the present disclosure comprises calculating and/or administering to a subject an amount of modified cells necessary to affect a therapeutic response in the subject. In some embodiments, calculating the amount of engineered cells necessary to affect a therapeutic response comprises the viability of the cells and/or the efficiency with which a transgene has been integrated into the genome of a cell. In some embodiments, in order to affect a therapeutic response in a subject, modified cells that can be administered to a subject can be viable. In some embodiments, in order to effect a therapeutic response in a subject, at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10% of the cells are viable cells. In some embodiments, in order to affect a therapeutic response in a subject, the RHDC polypeptide modified cells administered to a subject can be cells that have had one or more transgenes successfully integrated into the genome of the cell. In some embodiments, in order to effect a therapeutic response in a subject, at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10% of the cells have had one or more transgenes successfully integrated into the genome of the cell.

The methods disclosed herein can be used for treating or preventing disease including, but not limited to, cancer, cardiovascular diseases, lung diseases, liver diseases, skin diseases, or neurological diseases by administering to a subject in need thereof. RNase-H like domain containing peptide modified cells.

Transplanting can be by any type of transplanting. Sites can include, but not limited to, liver subcapsular space, splenic subcapsular space, renal subcapsular space, omentum, gastric or intestinal submucosa, vascular segment of small intestine, venous sac, testis, brain, spleen, or cornea. For example, transplanting can be subcapsular transplanting.

Transplanting can also be intramuscular transplanting. Transplanting can be intraportal transplanting.

Transplanting can be of one or more cells from a human. For example, the one or more cells can be from an organ, which can be a brain, heart, lungs, eye, stomach, pancreas, kidneys, liver, intestines, uterus, bladder, skin, hair, nails, ears, glands, nose, mouth, lips, spleen, gums, teeth, tongue, salivary glands, tonsils, pharynx, esophagus, large intestine, small intestine, rectum, anus, thyroid gland, thymus gland, bones, cartilage, tendons, ligaments, suprarenal capsule, skeletal muscles, smooth muscles, blood vessels, blood, spinal cord, trachea, ureters, urethra, hypothalamus, pituitary, pylorus, adrenal glands, ovaries, oviducts, uterus, vagina, mammary glands, testes, seminal vesicles, penis, lymph, lymph nodes or lymph vessels. The one or more cells can also be from a brain, heart, liver, skin, intestine, lung, kidney, eye, small bowel, or pancreas. The one or more cells can be from a pancreas, kidney, eye, liver, small bowel, lung, or heart. The one or more cells can be from a pancreas. The one or more cells can be pancreatic islet cells, for example, pancreatic β cells. The one or more cells can be any blood cells, such as peripheral blood mononuclear cell (PBMC), lymphocytes, monocytes or macrophages. The one or more cells can be any immune cells such as lymphocytes, B cells, or T cells.

The method disclosed herein can also comprise transplanting one or more cells (e.g., autologous cells or allogeneic cells), wherein the one or more cells can be can be any types of cells. For example, the one or more cells can be epithelial cells, fibroblast cells, neural cells, keratinocytes, hematopoietic cells, melanocytes, chondrocytes, lymphocytes (B and T), macrophages, monocytes, mononuclear cells, cardiac muscle cells, other muscle cells, granulosa cells, cumulus cells, epidermal cells, endothelial cells, pancreatic islet cells, blood cells, blood precursor cells, bone cells, bone precursor cells, neuronal stem cells, primordial stem cells, hepatocytes, keratinocytes, umbilical vein endothelial cells, aortic endothelial cells, microvascular endothelial cells, fibroblasts, liver stellate cells, aortic smooth muscle cells, cardiac myocytes, neurons, Kupffer cells, smooth muscle cells, Schwann cells, and epithelial cells, erythrocytes, platelets, neutrophils, lymphocytes, monocytes, eosinophils, basophils, adipocytes, chondrocytes, pancreatic islet cells, thyroid cells, parathyroid cells, parotid cells, tumor cells, glial cells, astrocytes, red blood cells, white blood cells, macrophages, epithelial cells, somatic cells, pituitary cells, adrenal cells, hair cells, bladder cells, kidney cells, retinal cells, rod cells, cone cells, heart cells, pacemaker cells, spleen cells, antigen presenting cells, memory cells, T cells, B cells, plasma cells, muscle cells, ovarian cells, uterine cells, prostate cells, vaginal epithelial cells, sperm cells, testicular cells, germ cells, egg cells, leydig cells, peritubular cells, sertoli cells, lutein cells, cervical cells, endometrial cells, mammary cells, follicle cells, mucous cells, ciliated cells, nonkeratinized epithelial cells, keratinized epithelial cells, lung cells, goblet cells, columnar epithelial cells, dopamiergic cells, squamous epithelial cells, osteocytes, osteoblasts, osteoclasts, dopaminergic cells, embryonic stem cells, fibroblasts and fetal fibroblasts. Further, the one or more cells can be pancreatic islet cells and/or cell clusters or the like, including, but not limited to pancreatic α cells, pancreatic β cells, pancreatic δ cells, pancreatic F cells (e.g., PP cells), or pancreatic c cells. In one instance, the one or more cells can be pancreatic α cells. In another instance, the one or more cells can be pancreatic β cells.

A donor can be at any stage of development including, but not limited to, fetal, neonatal, young and adult. For example, donor T cells can be isolated from an adult human Donor human T cells can be under the age of 10, 9, 8, 7, 6, 5, 4, 3, 2, or 1 year(s). For example, T cells can be isolated from a human under the age of 6 years. T cells can also be isolated from a human under the age of 3 years. A donor can be older than 10 years.

Kits

Disclosed herein can be kits comprising compositions. Disclosed herein can also be kits for the treatment or prevention of a cancer, pathogen infection, immune disorder or allogeneic transplant. In one embodiment, a kit can include a therapeutic or prophylactic composition containing an effective amount of a composition of nuclease modified cells in unit dosage form. In some embodiments, a kit comprises a sterile container which can contain a therapeutic composition of engineered T cells; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments. In some cases, RHDC polypeptide modified cells can be provided together with instructions for administering the cells to a subject having or at risk of developing a cancer, pathogen infection, immune disorder or allogeneic transplant. Instructions can generally include information about the use of the composition for the treatment or prevention of cancer, pathogen infection, immune disorder or allogeneic transplant. In some cases, a kit can include from about $1\times10^4$ cells to about $1\times10^{12}$ cells. In some cases a kit can include at least about $1\times10^5$ cells, at least about $1\times10^6$ cells, at least about $1\times10^7$ cells, at least about $4\times10^7$ cells, at least about $5\times10^7$ cells, at least about $6\times10^7$ cells, at least about $6\times10^7$ cells, at least about $8\times10^7$ cells, at least about $9\times10^7$ cells, at least about $1\times10^8$ cells, at least about $2\times10^8$ cells, at least about $3\times10^8$ cells, at least about $4\times10^8$ cells, at least about $5\times10^8$ cells, at least about $6\times10^8$ cells, at least about $6\times10^8$ cells, at least about $8\times10^8$ cells, at least about $9\times10^8$ cells, at least about $1\times10^9$ cells, at least about $2\times10^9$ cells, at least about $3\times10^9$ cells, at least about $4\times10^9$ cells, at least about $5\times10^9$ cells, at least about $6\times10^9$ cells, at least about $6\times10^9$ cells, at least about $8\times10^9$ cells, at least about $9\times10^9$ cells, at least about $1\times10^{10}$ cells, at least about $2\times10^{10}$ cells, at least about $3\times10^{10}$ cells, at least about $4\times10^{10}$ cells, at least about $5\times10^{10}$ cells, at least about $6\times10^{10}$ cells, at least about $6\times10^{10}$ cells, at least about $8\times10^{10}$ cells, at least about $9\times10^{10}$ cells, at least about $1\times10^{11}$ cells, at least about $2\times10^{11}$ cells, at least about $3\times10^{11}$ cells, at least about $4\times10^{11}$ cells, at least about $5\times10^{11}$ cells, at least about $6\times10^{11}$ cells, at least about $6\times10^{11}$ cells, at least about $8\times10^{11}$ cells, at least about $9\times10^{11}$ cells, or at least about $1\times10^{12}$ cells. For example, about $5\times10^{10}$ cells can be included in a kit. In another example, a kit can include $3\times10^6$ cells; the cells can be expanded to about $5\times10^{10}$ cells and administered to a subject.

In some cases, a kit can include allogenic cells. In some cases, a kit can include cells that can comprise a genomic modification. In some cases, a kit can comprise "off-the-shelf" cells. In some cases, a kit can include cells that can be expanded for clinical use. In some cases, a kit can contain contents for a research purpose.

In some cases, the instructions include at least one of the following: description of the therapeutic agent; dosage schedule and administration for treatment or prevention of a neoplasia, pathogen infection, immune disorder or allogeneic transplant or symptoms thereof; precautions; warnings; indications; counter-indications; overdosage information; adverse reactions; animal pharmacology; clinical studies; and/or references. The instructions can be printed directly on the container (when present), or as a label applied to the container, or as a separate sheet, pamphlet, card, or folder supplied in or with the container. In some cases, instructions provide procedures for administering nuclease modified cells at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or up to 2 days, 3 days, 4 days, 5 days, 6 days, or 7 days after administering a chemotherapeutic agent. In some cases, instructions provide procedures for administering engineered cells at least 24 hours after administering a chemotherapeutic agent. Nuclease modified cells can be formulated for intravenous injection. Nuclease modified cells can be formulated for infusion. In some cases a kit can contain products at a pediatric dosage.

Further uses of the methods, compositions, or kits described herein can include one or more of the following: genome editing, transcriptional or epigenetic regulation, genome imaging, copy number analysis, analysis of living cells, detection of highly repetitive genome sequence or structure, detection of complex genome sequences or structures, detection of gene duplication or rearrangement, enhanced FISH labeling, unwinding of target nucleic acid, large scale diagnostics of diseases and genetic disorders related to genome deletion, duplication, and rearrangement, use of an RNA oligo chip with multiple unique gRNAs or gDNAs for high-throughput imaging and/or diagnostics, multicolor differential detection of target sequences, identification or diagnosis of diseases of unknown cause or origin, and 4-dimensional (e.g., time-lapse) or 5-dimensional (e.g., multicolor time-lapse) imaging of cells (e.g., live cells), tissues, or organisms.

EXAMPLES

Example 1: Nuclease Mining

Figure 2:
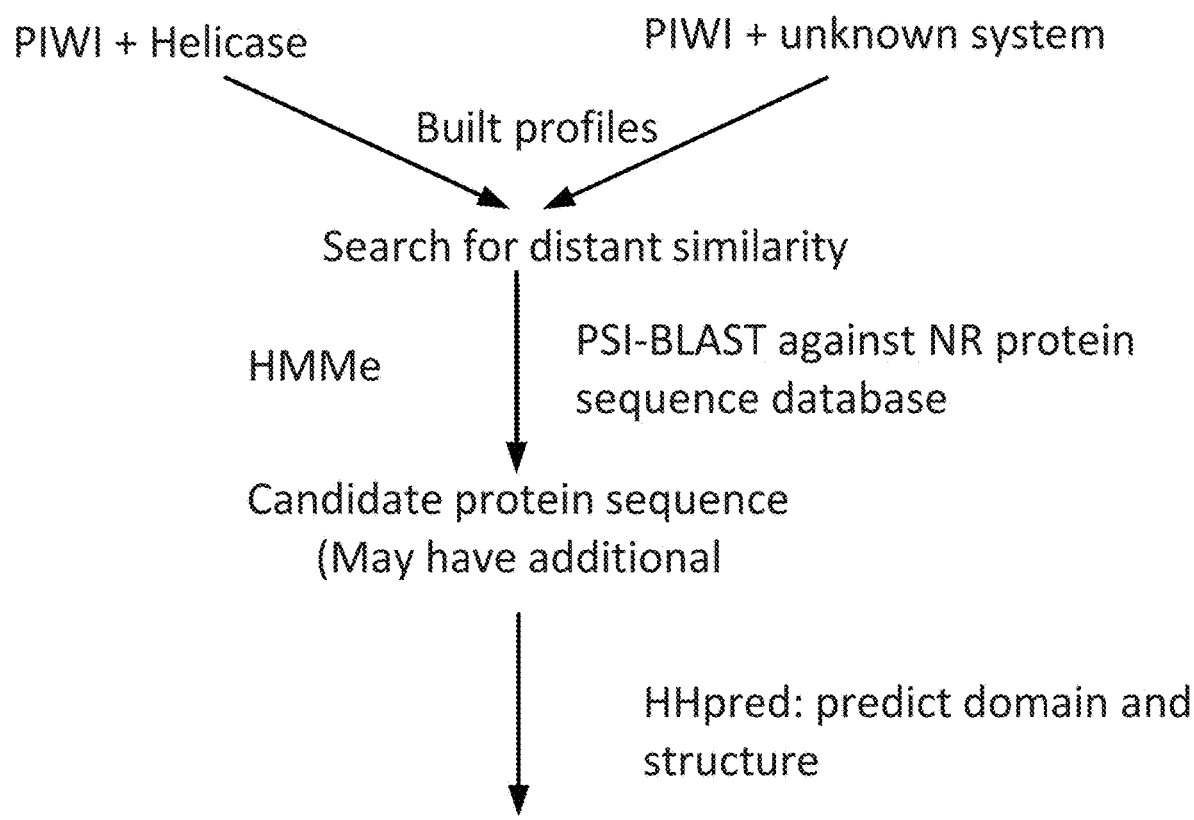
FIG. 2 shows a mining strategy for nuclease identification based on PIWI domain identification.
Figure 4:
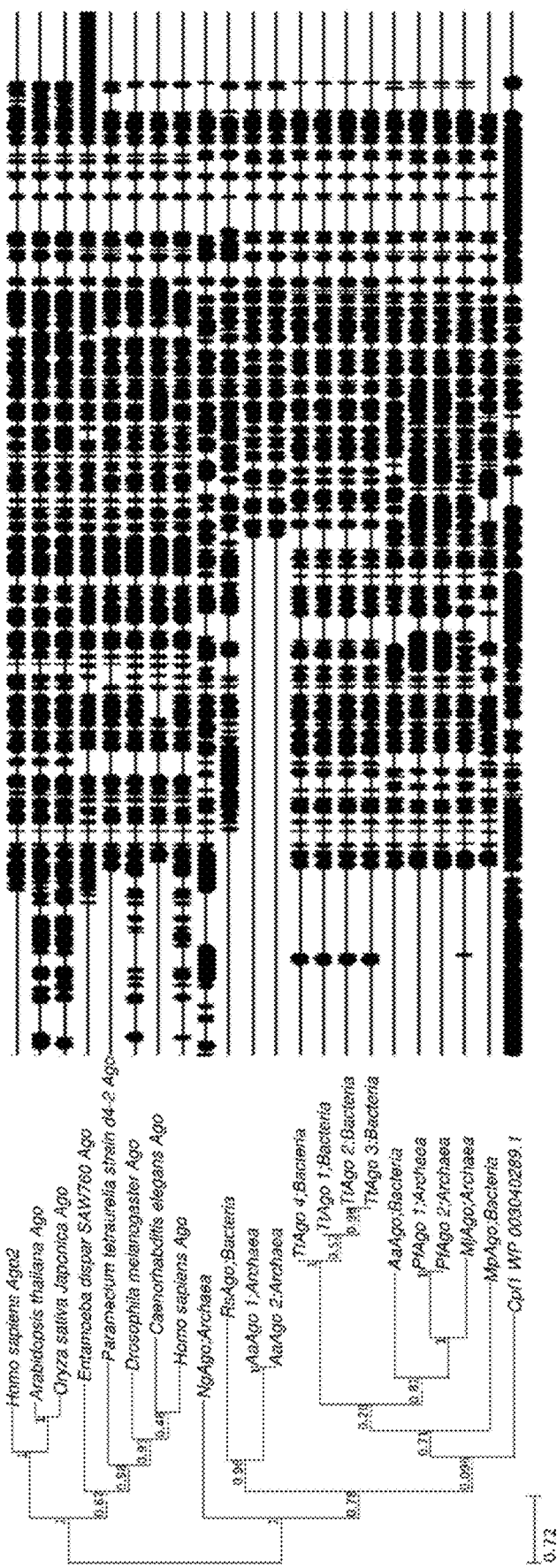
FIG. 4 shows a phylogenetic tree. On the right is homology between predicted structural alignment. From left to right is position 0 to end of protein. Black boxes are conserved domains.
Figure 6:
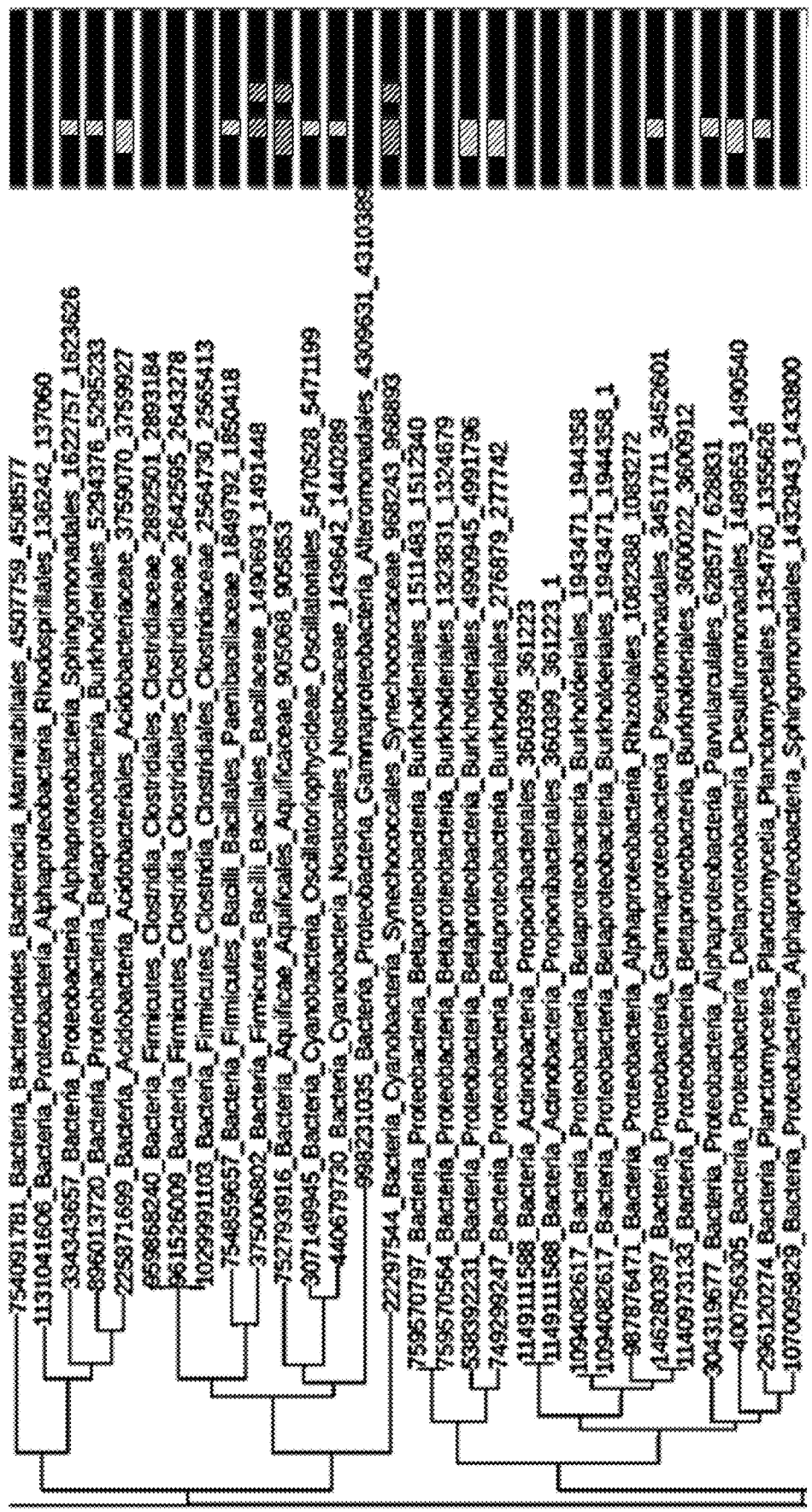
FIG. 6 shows a phylogenetic tree of Argonaute genes with a nearby helicase. Blue indicates that the Argonaute gene is from a mesophilic organism; red indicates that the Argonaute gene is from a thermophilic organism.
Figure 6:
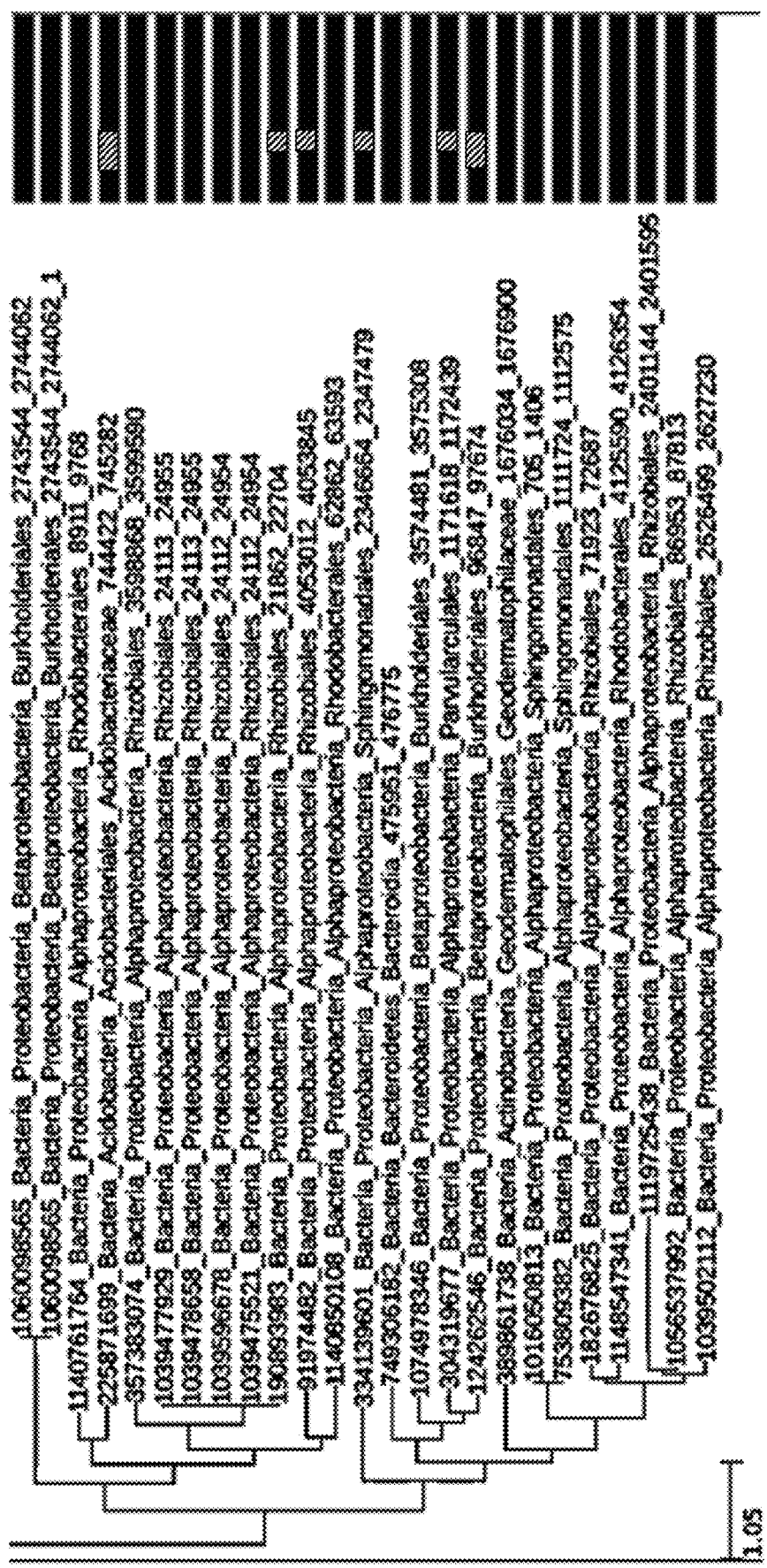
Figure 7A:
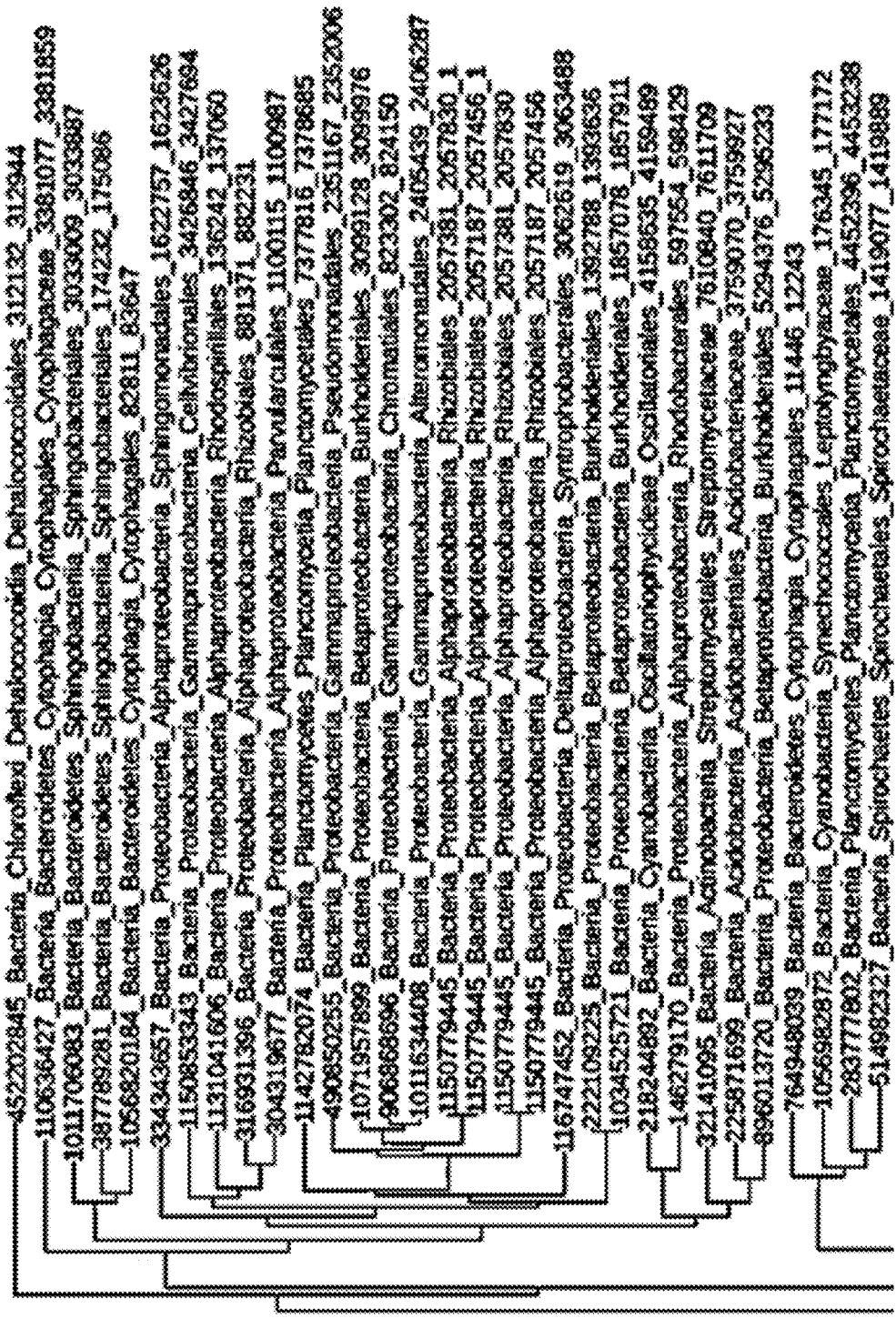
FIGS. 7A-7D show a phylogenetic tree of Argonaute proteins. Blue indicates that the Argonaute protein is from a mesophilic organism; red indicates that the Argonaute protein is from a thermophilic organism.
Figure 7A:
Figure 7B:
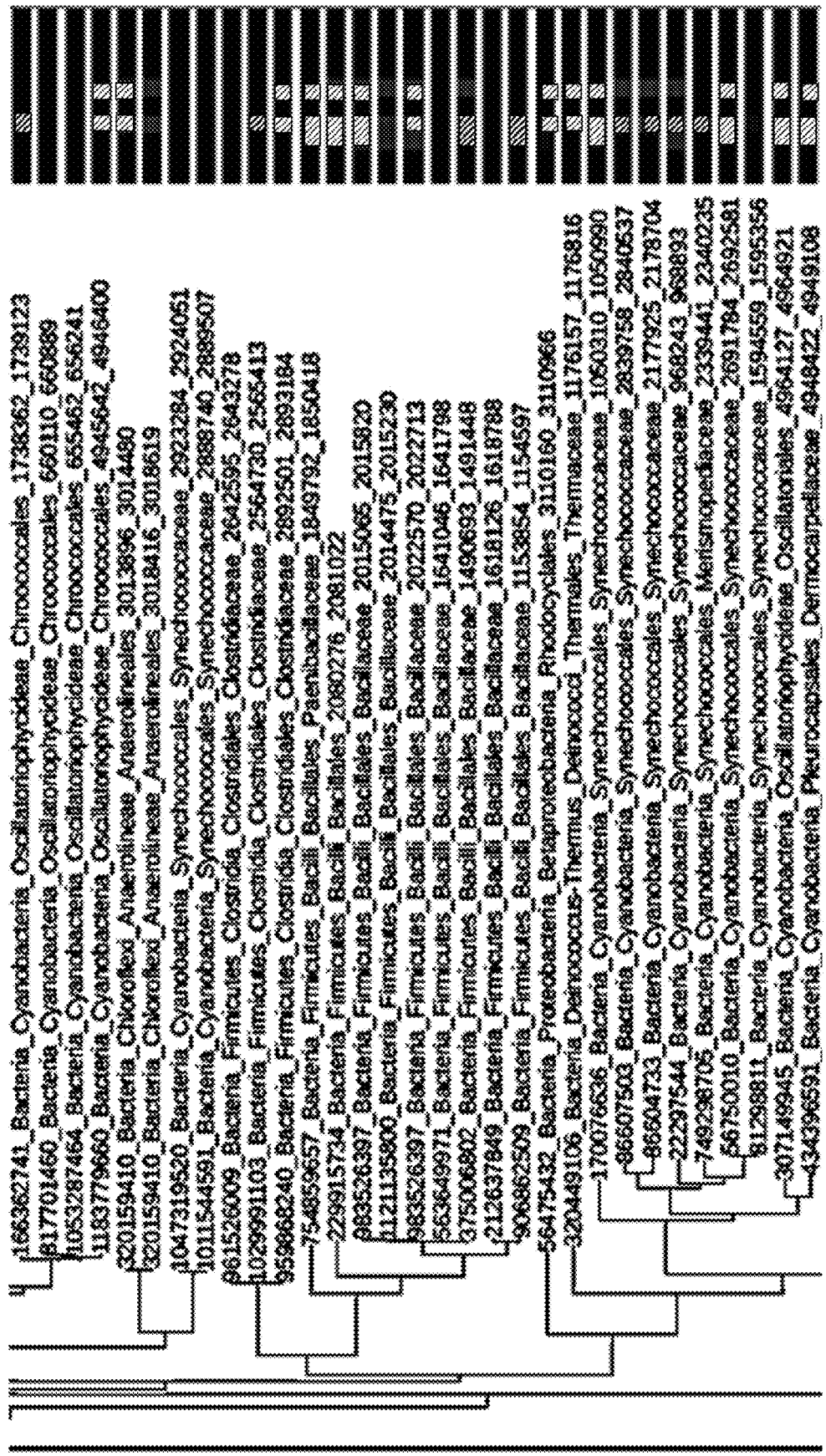
Figure 7C:
Figure 7C:
Figure 7D:
Figure 7D:
Figure 8B:
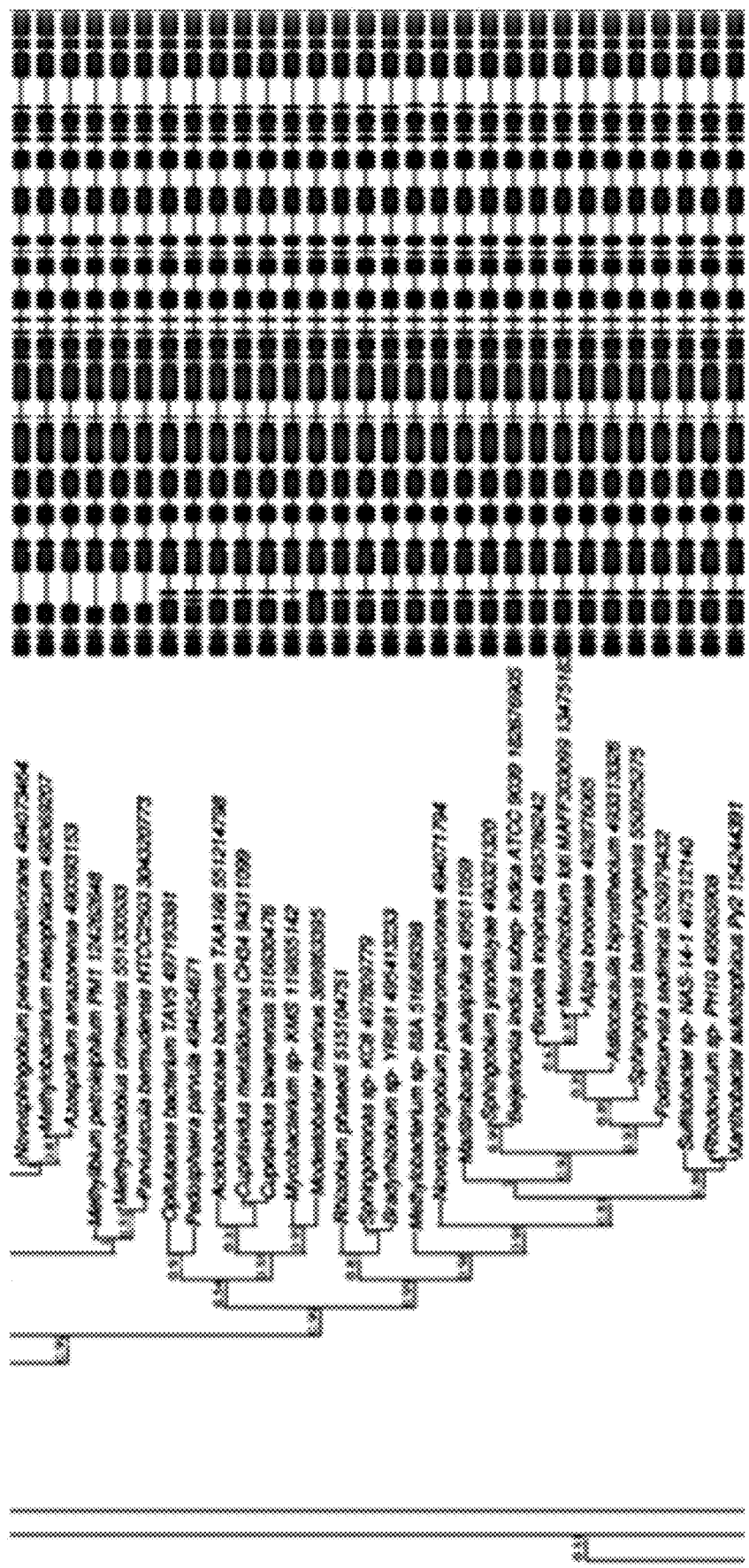

Pipeline 1
An NCBI RefSeq database was used to search the WIPI location of various PIWI sequences using TBlastN. Sequences that were analyzed had WIPI 1 hit +/−10 kb Amino acid sequences were predicted using GeneMarS for relevant hits. Relevant hits were grouped into protein families, secondary structure and functional enrichment of adjacent regions. Protein family hits were analyzed against the CDD database. Secondary structures were analyzed. Functional enrichment analysis reviewed adjacent regions for domains involved in defense, stress response, Cas system, DNA repair, or toxin defense, FIG. 2

Pipeline 2
An NCBI RefSeq database was used to search the WIPI location of various PIWI sequences using TBlastN. Sequences that were analyzed had WIPI 1 hit +/−10 kb Amino acid sequences were predicted using GeneMarS for relevant hits. Relevant hits were analyzed using amino acids in ORFs using RPS-BLAST against the CDD database. Candidate Argonaute sequences were identified.

Results
Argonaute was encoded in ~65% of the sequenced eukaryotic genomes, dispersed over at least four of the five eukaryotic supergroups. In contrast, a position-specific iterative basic local alignment search tool (PSI-BLAST) search of the RefSeq database (November 2013) using representative PIWI domain sequences as queries shows that Ago proteins are encoded in ~32% and ~9% of the available archaeal and bacterial genomes, respectively, and in 17 of 37 prokaryotic phyla. Similarly to most prokaryotic defense genes42, pAgo shows a patchy distribution, with at most 70% representation in any bacterial or archaeal phylum.

TABLE 10

Nuclease origin summary

|  | Number of Species | Number of Hits |
|---|---|---|
| Bacteria | 1300 (of 45,031) | 1363 |
| Archaea | 83 (of 1,012) | 87 |
| Eukaryote | 1392 | 6693 |

TABLE 11

Taxonomic Distribution Count

| Acidobacteria | 5 |
|---|---|
| Actinobacteria | 44 |
| Aquificae | 1 |
| Bacteroidetes | 60 |
| Balneolaeota | 1 |
| Chlorobi | 1 |
| Chloroflexi | 9 |
| Cyanobacteria | 48 |
| Deinococcus-Thermus | 16 |
| Firmicutes | 62 |
| Nitrospirae | 2 |
| Planctomycetes | 13 |
| Proteobacteria | 504 |
| Spirochaetes | 3 |
| Verrucomicrobia | 6 |

TABLE 12

Taxonomic Distribution

| Taxonomy | Count |
|---|---|
| Alphaproteobacteria | 244 |
| Betaproteobacteria | 95 |
| Deltaproteobacteria | 8 |
| Gammaproteobacteria | 151 |
| Zetaproteobacteria | 2 |

Example 2: Identifying Suitable Nucleases

A suitable nuclease is identified by secondary structural alignment to an RNase-H protein from individual genome sequences or gene assemblies from metagenomics. RNase-H1, RNase-HIII, RVE/Transp, Argonaute, Prp8, RuvC, RuvC, RuvX, RNaseT, and DNAPoIII were aligned, and alignment results revealed that these proteins share secondary structural homology. Structural alignments confirm the presence of a nuclease domain.

Example 3: RNase-H-Like Domain-Containing (RHDC) Polypeptide Constructs

An RNase-H-like domain-containing (RHDC) polypeptide (e.g., an Argonaute protein) is fused to a nucleic acid unwinding polypeptide (e.g., a helicase domain) via a designed or screened peptide linker sequence, utilizing PCR techniques, molecular cloning or recombinant DNA techniques. The resulting fusion polypeptide is isolated and purified.

Example 4: Synthetic Helicase-Argonaute Fusion Constructs

A catalytically dead Cas9 (e.g., dCas9), is guided to a target sequence by a single guide RNA (sgRNA). To achieve genomic disruption, dCas9 can be used by itself (whereby it represses transcription through steric hindrance) or as a helicase. DCas9 when fused to an RHDC polypeptide, or functional portion thereof, allows for a two-step genome editing system whereby dCas9 is first directed to the target sequence where it unwinds the double strand helix at a targeted site within the target sequence and in a second step, the RHDC executes a genomic break at the unwound target sequence.

Example 5: Genomic Engineering Using RNase-H-Like Domain-Containing (RHDC) Polypeptide Constructs Neon Transfection of T Cells Unstimulated or stimulated T cells are electroporated using the Neon Transfection System (10 uL Kit, Invitrogen, Life Technologies). Cells are counted and resuspended at a density of $2\times10^5$ cells in 10 uL of T buffer. 1 ug of Argonaute-helicase construct or mRNA and 1 ug of gRNA targeting a target gene (e.g., an immune checkpoint gene) plasmid or mRNA are added to the cell mixture. Cells are electroporated at 1400 V, 10 ms, 3 pulses. After transfection, cells are plated in a 200 uL culturing media in a 48 well plate.

Flow Cytometry

Electroporated T cells are analyzed by flow cytometry 24-48 hours post transfection for expression of the disrupted target gene. Cells are prepped by washing with chilled 1xPBS with 0.5% FBS and stained with APC anti-human CDR (eBiosciences, San Diego) and Fixable Viability Dye eFlour 780 (eBiosciences, San Diego). The following mAbs and reagents are used with the indicated specificity and the appropriate isotype controls. From BD Biosciences: APC-conjugated anti-CD3 (555335), FITC-anti-CD8 (555366), PE-anti-CD8 (555635), PE-anti-CD28 (561793), PE-anti-CD107a (555801), and PE-anti-β-2 microglobulin (551337), FITC-anti-HLA-I (555552), APC-anti-CD137 (550890). From Biolegend: APC-anti-PD1 (114102), APC-anti-PDL1 (329702), FITC-anti-CD45RO (304204), APC-anti-CD62L (304814). From Beckman Coulter: PE-anti-Vb13.1 (IM2021U). Data are acquired on a FACS Accuri (BD Biosciences) using CellQuest version 3.3 (BD Biosciences) and analyzed by FCS Express version 3.00 (De Novo Software) or FlowJo version 7.6.1 (Tree Star, Inc.).

Measuring Allele Modification Frequencies Using T7E1 Assay, TIDE, and Sequencing of PCR Fragments The level of genomic disruption of a target gene in T cells is determined by a T7E1 Nuclease assay (NEB). The percent target disruption is quantified by densitometry. PCR products are ligated to TOPO cloning vector (Invitrogen) then transformed in E. coli. A single clone is picked and sequenced to calculate the indels and insertions. PD1 disruption is confirmed by Sanger sequencing. The PCR primers used for the amplification of the target locus are as follows: PD1 forward, 5'-GTAATAAAATGCTCAGCACAGAATA-3'(SEQ ID NO: 382); PD1 reverse, 5' GAGAAAAATATCACCAGCTCATCT-3' (SEQ ID NO: 383). For analyzing allele modification frequencies using TIDE (Tracking of Indels by Decomposition), the purified PCR products are Sanger-sequenced using both PCR primers and each sequence chromatogram is analyzed with the online TIDE software. Analyses are performed using a reference sequence from a Cas9 mock-transfected sample. Parameters are set to the default maximum indel size of 10 nucleotides and the decomposition window to cover the largest possible window with high quality traces. All TIDE analyses below the detection sensitivity of 1.5% are set to 0%.

ELISA Assays

Target cells are washed and suspended at $1\times10^6$ cells/mL in R10 medium. Next, 100 µL of each target cell type is added in triplicate to a 96-well round-bottom plate (Corning). Effector T cells are washed and resuspended at $1\times10^6$ cells/mL in R10 medium, and then 100 µL of T cells are combined with the target cells in the indicated wells. The plates are incubated at 37° C. for 18 to 24 hours. After the incubation, the supernatant is harvested and subjected to an ELISA (eBioscience).

IFNγ ELISpot

RNase-H-like domain-containing (RHDC) fusion construct-edited T cells are plated in ELISpot plates (R&D Systems) at the concentration of $2\times10^4$ cells per well with irradiated allogenic PBMCs. Another experiment is performed by co-culturing of allogenic PBMCs with irradiated edited T cells. Cells were incubated for 18 hours at a stimulator-to-responder ratio of 1:1. Experiments are performed according to the manufacturer's instructions. The spots are automatically quantified using an ELISpot plate reader for scanning and analyzing.

Example 6: Detection of Genomic Disruption at the Protein Level

To determine whether observed knockout frequencies at the genetic level correlate with loss of protein; the expression of target protein after knockout is assessed. Peripheral blood (PB) T-cells and TILs are re-stimulated at day 14 post-electroporation using plate bound anti-CD3 and soluble anti-CD28 antibody and assessed the loss of target gene by Coomassie Blue stained gel.

Example 7: RHDC Gene Cutting Assay

Figure 9:
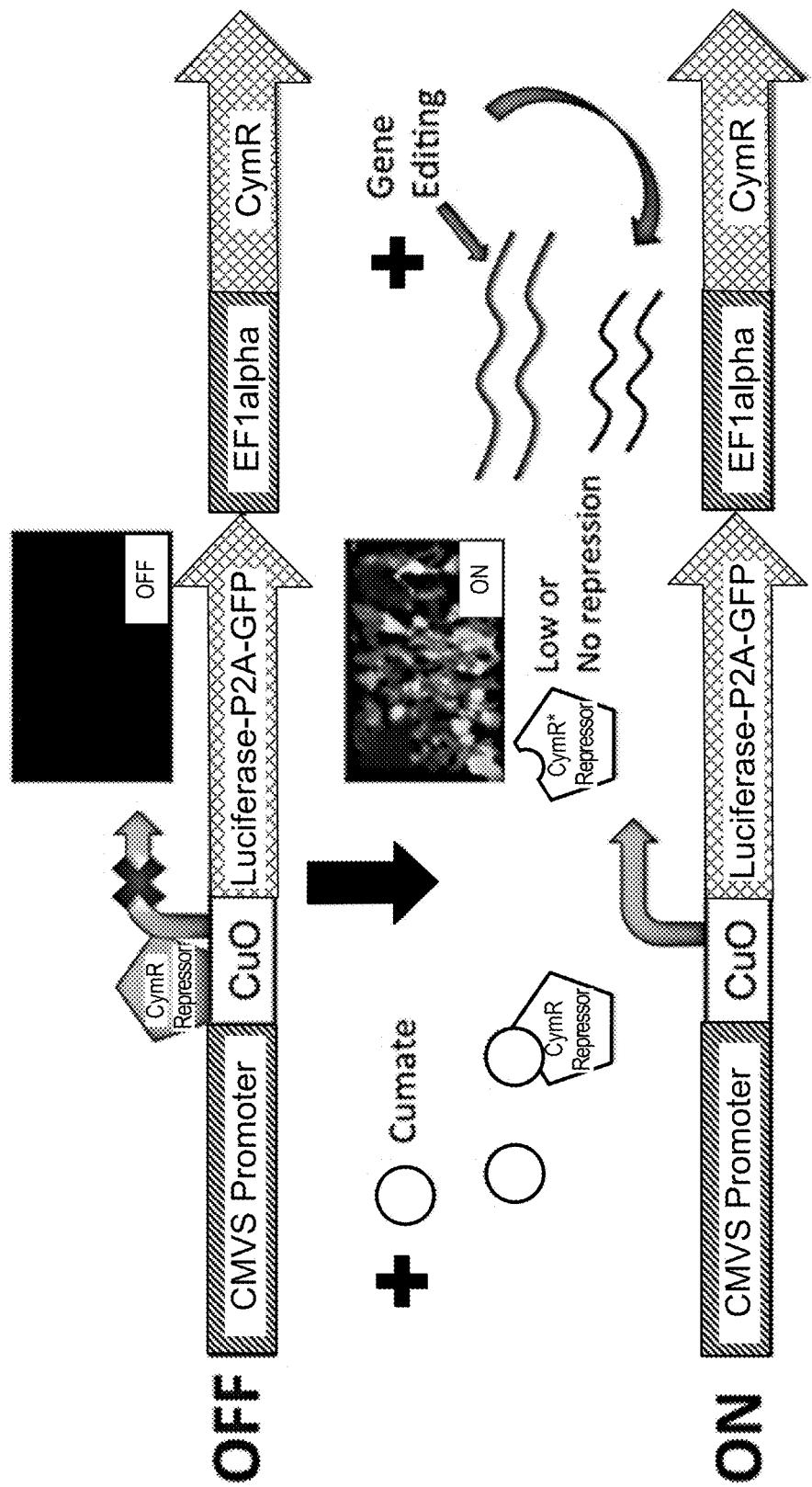
FIG. 9 shows a schematic of a gain-of-function gene editing reporter system.

Gene Editing Reporter System:

The RHDC gene cutting assay is a highly sensitive gain-of-function mammalian gene editing reporter system, FIG. 9. Transient plasmid DNA, FIG. 10, was transfected into HEK293T QMS cells in wells of a 24-well plate. All plasmids were prepared from E coli stellar cell using endotoxin-free DNA preparation kit. In summary, $5\times10^4$ cells were plated in 0.5 ml complete DMEM growth medium per well in a 6-well plate. Cell cultures were incubated under 37° C. for approximately 24-36 hours before transfection. Cells were about 60-70% confluent prior to transfection.

A: Immediately before transfection the TransIT-LT1 Reagent: DNA complex was made Table 13.

TABLE 13

Figure 11:
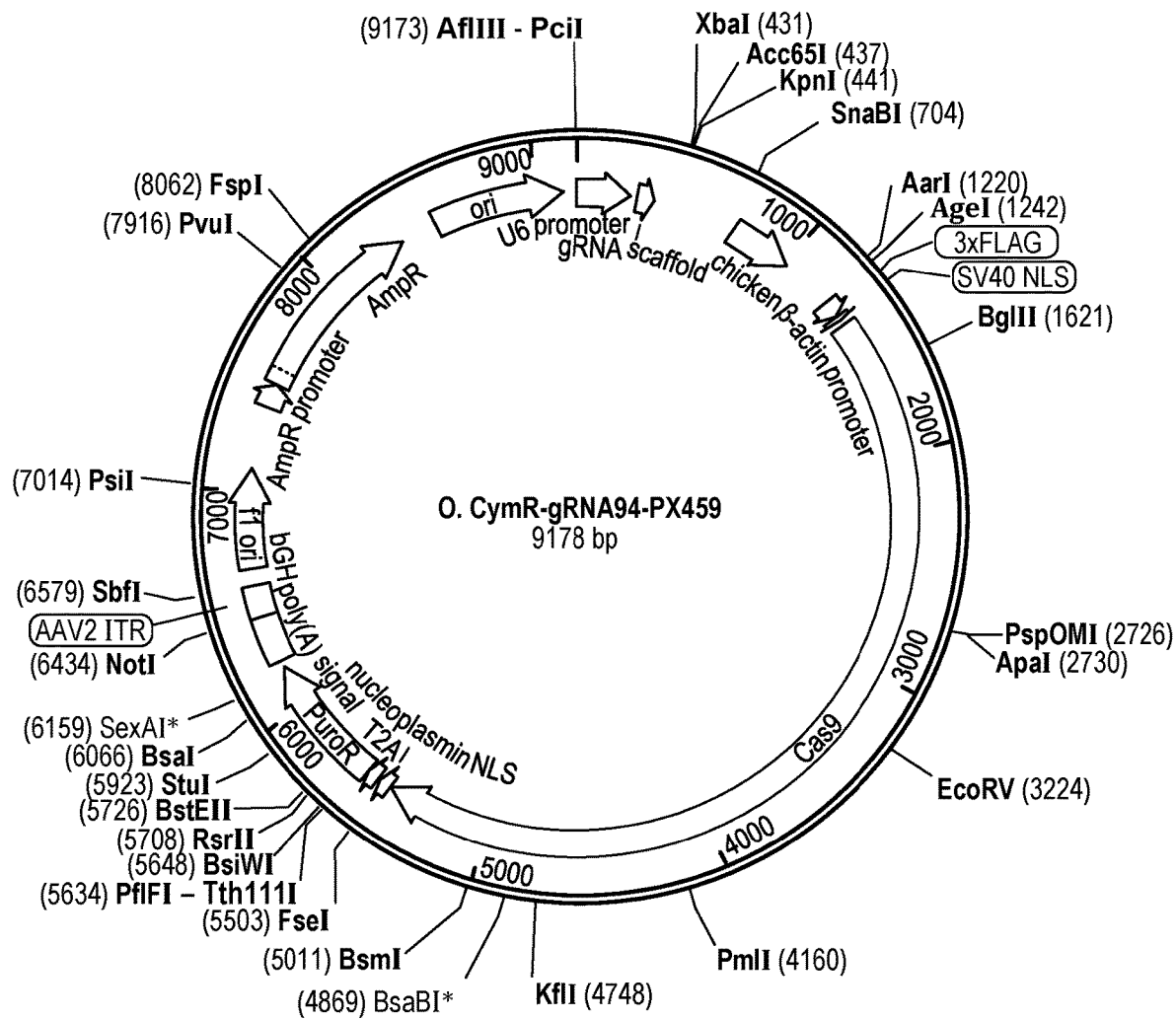
FIG. 11 shows a map of the SpCas9 and sgCymR expression plasmid, pX459-sgCymR-94.
Figure 12:
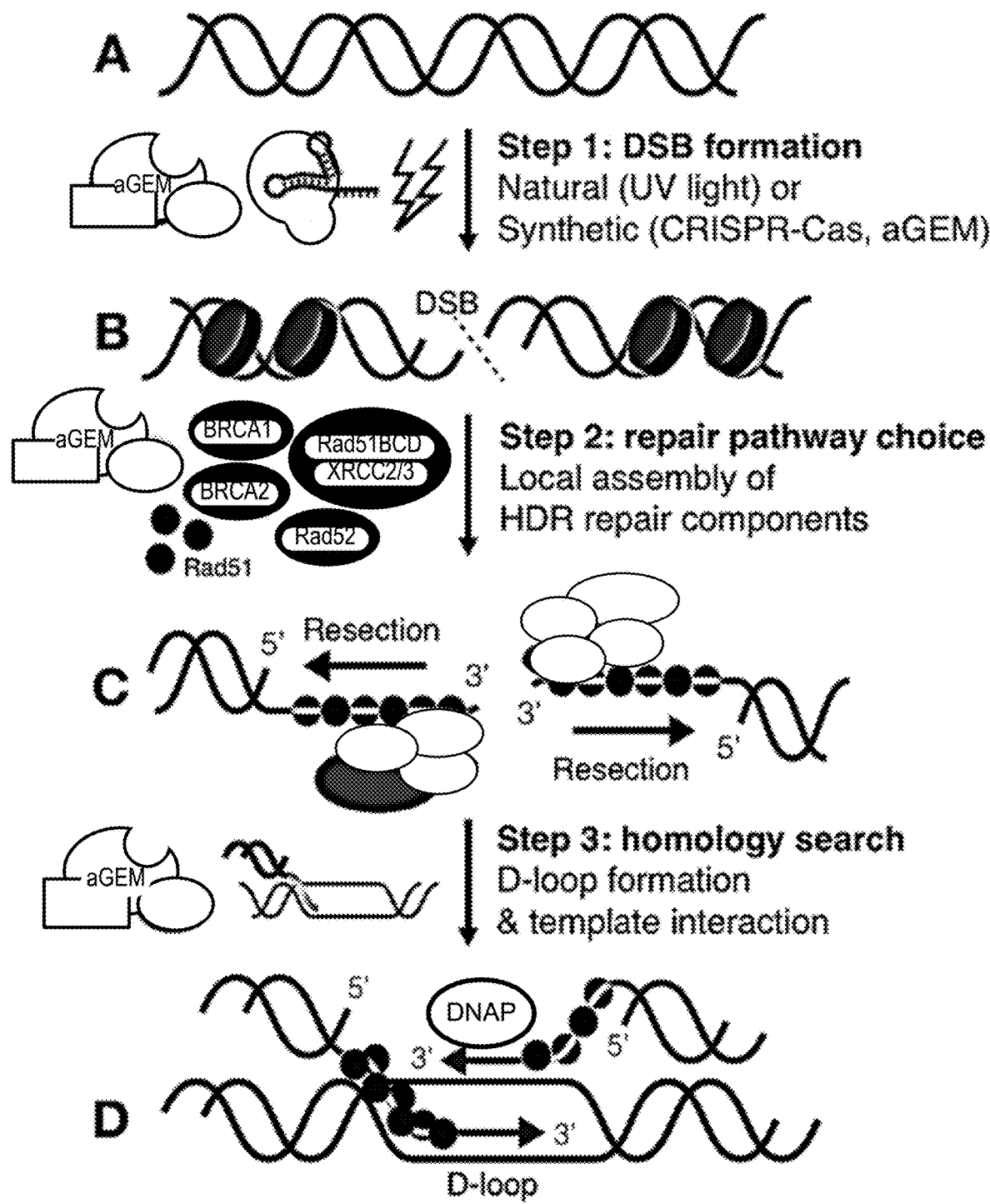
FIG. 12 depicts a schematic of RDP-homology directed repair enhancement. To note, artificial genome editor molecule (aGEM).

| TransIT-LT1 Reagent: DNA complex recipe | |
|---|---|
| Recipe | in 24 well plate |
| Opt | 50 ul |
| TransIt reagent | 1.5 ul |
| pX459-cymR-94 plasmid, FIG. 11 | 0.5-1 ug |

The Reagent: DNA complex was generated by: Warming the TransIT-LT1 Reagent to room temperature and vortexing gently before use. 50 µL of Opti-MEM I Reduced-Serum Medium was placed in a sterile 1.5 ml tube. 1 µg plasmid DNA was added followed by pipetting to mix completely. 1.5 µL TransIT-LT1 Reagent was added to the DNA mixture and pipetted gently. A 30 min incubation was finally performed.

B: Complexes were Distributed to Cells in Complete Growth Medium

The TransIT-LT1 Reagent: DNA complexes were added drop-wise to different areas of the wells. The plate was gently rocked back-and-forth and from side-to-side to evenly distribute the TransIT-LT1 Reagent: DNA complexes. The mixture was incubated under 37° C. Cells were passaged as necessary.

C: Flow Cytometry Analysis of Transfected Cells

Transfected cells were trypsinized utilizing 0.25% Trypsin. The cells were spun down at 500 g for 5 minutes and resuspended in DPBS with 5% FBS and 0.5m EDTA and passed through the top-filter of 5ml FACS tubes. Cells were analyzed using a Beckman CytoFlex flow cytometer at Day3, Day 6 and Day10.

RHDC Gene Editing in HEK293T

Figure 10:
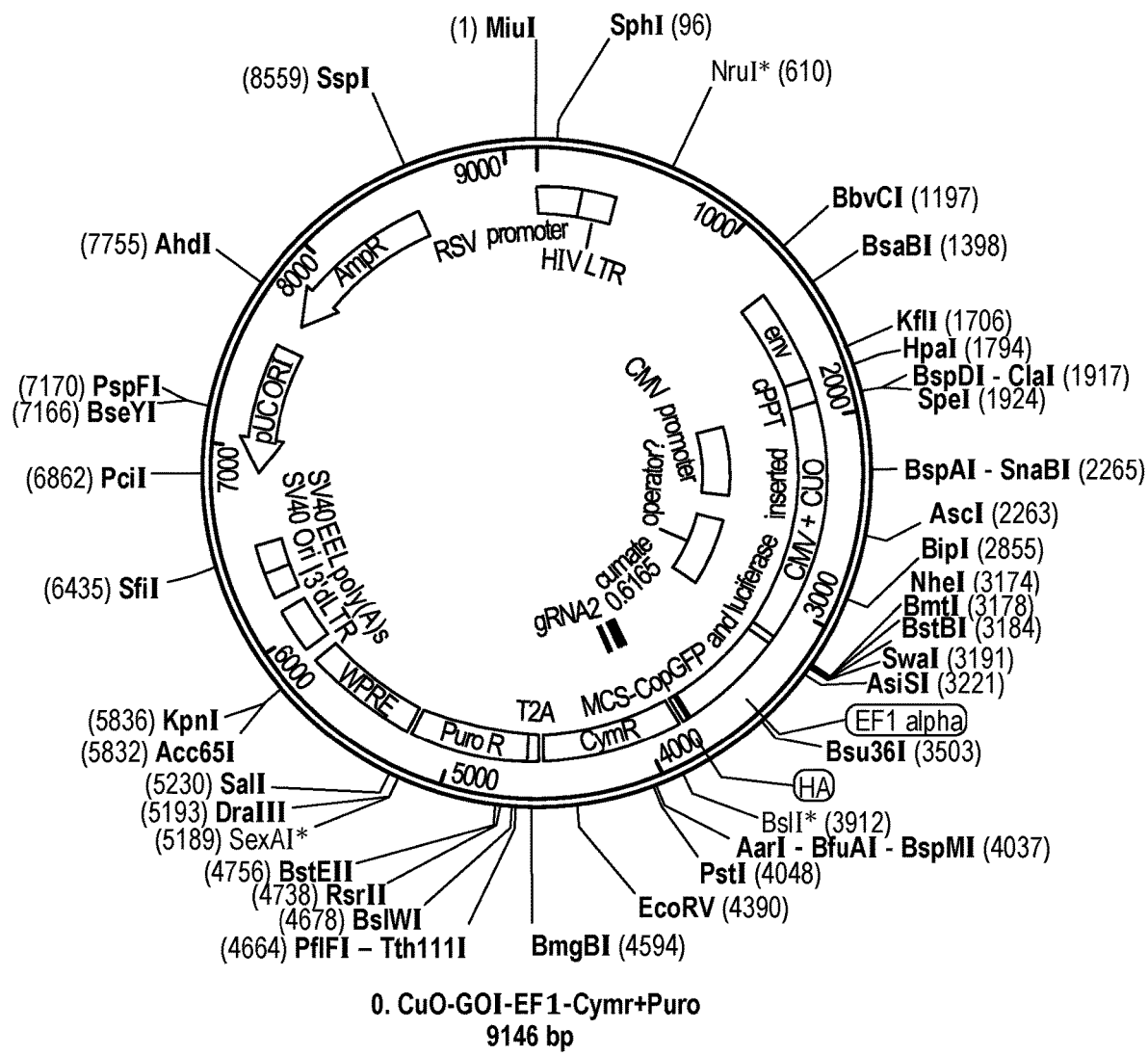
FIG. 10 depicts a map of a lentiviral plasmid integrated into HEK 293T to generate reporter cell line, HEK293T QMS (CMVS-CuO luc-p2A-GFP, EF1alpha-cymR).

Transient plasmid DNA, FIG. 10, was transfected into HEK293T QMS cells in wells of a 24-well plate. All plasmids were prepared from E coli stellar cell using endotoxin-free DNA preparation kit. In summary, 5×10$^4$ cells were plated in 0.5 ml complete DMEM growth medium per well in a 6-well plate. Cell cultures were incubated under 37° C. for approximately 24-36 hours before transfection. Cells were about 60-70% confluent prior to transfection.

A: Immediately Before Transfection the Gene Cutting Mixture was Generated

TABLE 14

Recipe for Argonaute gene editing in HEK293T assay

| Recipe | in 24well | Note |
| --- | --- | --- |
| Ago plasmid DNA | 0.5 ug | in pMAXGFP or pHR backbone |
| sgDNA-F ODN | 250 ng | 5' phosphate |
| sgDNA-R ODN | 250 ng | 5' phosphate |
| Opt-MEM | 150 ul | — |
| TransIt reagent | 4.5 ul | — |
| dCas9 plasmid | 0.5 ug | pSLQ1339 |
| sgCymR plasmid | 0.2 ug | in pSLQ1371 backbone |

B: Complexes were Distributed to Cells in Complete Growth Medium

The mixture was added drop-wise to different areas of the wells. The plate was gently rocked back-and-forth and from side-to-side to evenly distribute the mixture. The mixture was incubated under 37° C. Cells were passaged as necessary.

C: Flow Cytometry Analysis of Transfected Cells

Transfected cells were trypsinized utilizing 0.25% Trypsin. The cells were spun down at 500 g for 5 minutes and resuspended in DPBS with 5% FBS and 0.5m EDTA and passed through the top-filter of 5ml FACS tubes. Cells were analyzed using a Beckman CytoFlex flow cytometer at Day3, Day 6 and Day10.

TABLE 15

Gene Cutting Assay Comparison

| | Ago only assay | Ago + dCas9 helper system assay |
| --- | --- | --- |
| Treatment1 | Ago plasmid + sgDNA ODN | Ago plasmid + sgDNA ODN + dCas9 plasmid + sgCymR |
| Treatment2 | Ago plasmid | dCas9 plasmid + sgCymR |
| Treatment3 | sgDNA ODN | — |
| Control1 | pX459-sgCymR94 | pX459-sgCymR94 |
| Control2 | cumate 30 uM | cumate 30 uM |
| Control3 | HEK293T QMS cell only | HEK293T QMS cell only |

Example 8: Genomic Thermodynamic Calculation of an Assembled Genetic Editing Molecule Measurement of energy of a genomic editing system of Assembled Genetic Editing Molecule (AGEM) can be calculated by considering the amount of ATP, ADP, and percentage of modified DNA.

Figure 34:
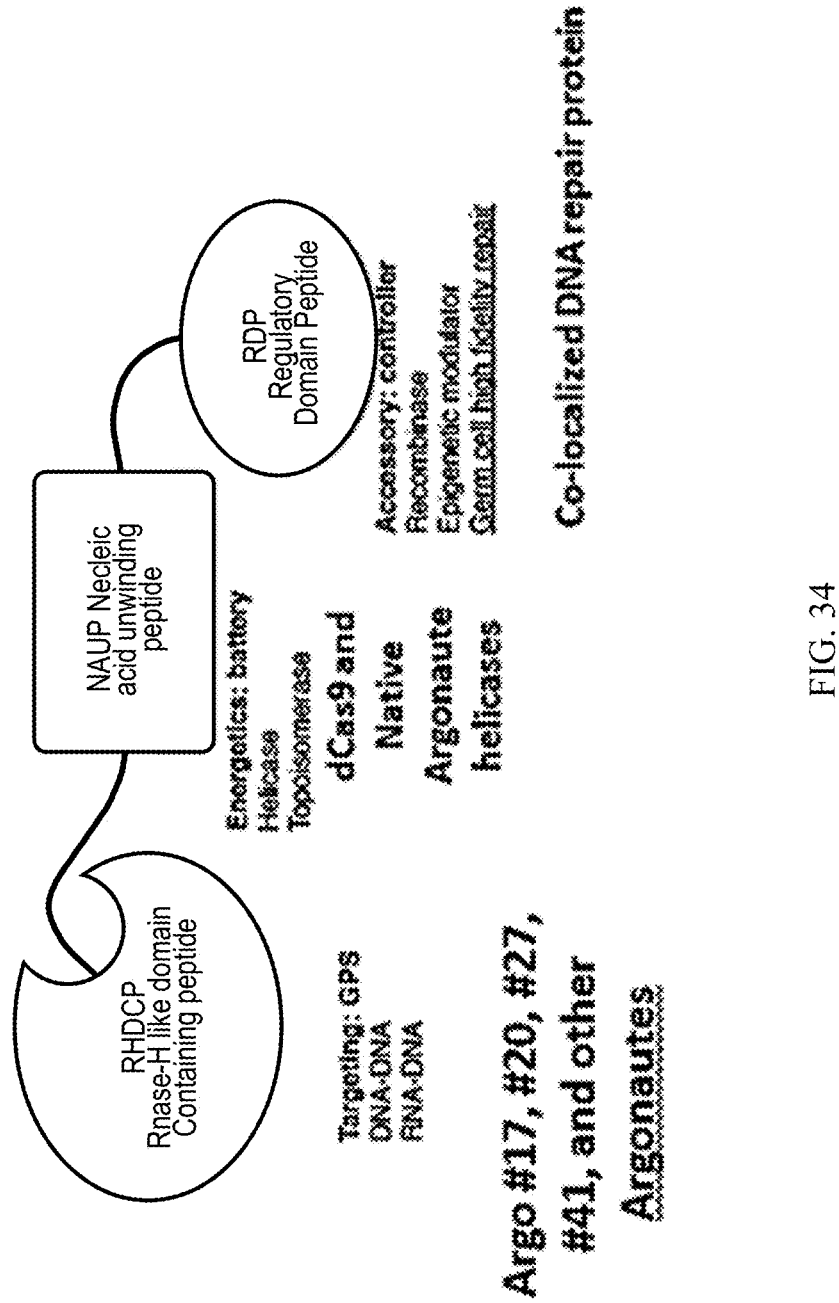
FIG. 34 depicts an exemplary schematic of the anatomy of an artificial genome editor molecule (aGEM). The aGEM contains an RNase-H like domain containing protein, a nucleic acid unwinding agent, and a regulatory domain agent.

AGEM is a modular system comprising an RNase H-like domain-containing (RHDC) polypeptide, a nucleic acid unwinding polypeptide, and an optional regulatory domain polypeptide (RDP), FIG. 34. The energy cost of a genetic thermodynamic reaction can be measured in a biochemical system, by providing finite amount of ATP into the reaction. At the end of the reaction, a quantification of the amount of DNA that is properly modified and the amount of ATP and ADP remaining in the reaction can be analyzed by calculating ([ATP]-[ADP])/[modified DNA], FIG. 33. This formula can estimate how much energy per editing reaction is expended. The exact energy cost per editing event will differ as the modules of the editing system can be interchanged. For example, an RHDC can be interchanged to any nuclease domain (from a CRISPR system, Argonaute system, meganuclease, Zinc Finger nuclease (ZFN), TALEN, or any restriction enzyme system) without affecting the nucleic acid unwinding agent or RDP function.

A measurement of a genomic thermodynamic reaction of a genome editing molecule can be determined by taking dsDNA that is 100 bp in length which contains a perfect matching sequence for the guiding polynucleic acid (gDNA or gRNA) into the reaction. 1 uM of gene editing molecules are added and 1 uM of guide DNA or guide RNA is added such that a ratio is: gene editor:target DNA=1:1. 10:1 (10 uM) ATP is supplemented into the reaction. The reaction will be performed for 1 hour. At the end of the reaction, stop buffer is added to the reaction (e.g., MOPS). The amount of remaining ATP is measured by a standard ATP assay based on phosphorylation of glycerol to generate a product that is easily quantifiable by colorimetric (OD=570 nm) or fluorometric (Ex/Em=535/587 nm) assays. The amount of target DNA that is modified is quantified by a T7 Endonuclease I assay, which recognizes and cleaves non-perfectly matching DNA (the edited DNA) followed by polyacrylamide gel electrophoresis. The total energy consumed by the gene editing molecule is calculated by ([ATP]-[ATP]$_{remaining}$)/[Edited DNA].

Example 9: Helicases that Co-Localize with Argonauts and their Optimized Nucleic Acid Sequences The sequences described in Table 16 are optimized to remove any known restriction enzyme recognition sites, cryptic gene expression regulatory sites, sequences that are predicted to sequester transcription or translation, repetitive sequences that are more than 10 bp. The optimization doesn't change protein peptide sequences, and is purely based on the redundancy of codon usage for using different triplets of nucleotides to encode the same amino acid.

TABLE 16

| | Nucleotide sequences for Optimized Ago Helicases |
|---|---|
| SEQ ID NO | Sequence |
| 59 | ATGCCCAAAAAGAAAAGGAAAGTGGAAGACCCAAAAAAGAAAAGAAAAGTCGGATCCGGATCCATGTCTATCTTCGCAAATTC<br>ATTTGAAATTGAGGTTCCCACACTGCCCGCCGAAATATATAAGATCGATCCACAGCCGTCCGAGAGCGACCCCTGGAGGGCAC<br>TGGATTCCTATGAGGAAAGCATAGAACGGACTTGCCGCGGTAGCGCCCACCGCATTAAAAATTCTGGTGACTGGGCCATCTTG<br>TCCATCGCTGCCACGGATAGTCAAGATGAGCTTCAGGGGCCAGACGGGACCCGCCTGGTTAGGACTAGCGAGACCACAGTGGG<br>GGGTGAGAACGGAAGATACCAAAGCGCCGTGAAACAAGCCCTCCGCAACAGCCTCGAGTGGTTCGTAACAAACCACCTCGACT<br>TTTGGGAGAGGGGGAATAGCCAGGCATTCTACGAATGGGACCCAAGCAATACAGTGGGAATGTATGACGCCTATCACGGCTAC<br>AAAGCTACCATTGATTATAACGATGGGTACTATCTGACAGTGGACTCTACCGTGAAGTTTATTAGCTCCAAATCCATCAACGA<br>GTACCTGTCAGAGCTCGGGCGAGACGTAGTGAAGACTCGCTTCTTCGACAGGTATTGCACACTGATGTCAGACAGCCGCCCCA<br>GCGTTGAGCTCGTATCCCTGGCAGAGGATTTGACGGTGAGTGACAAGACCATGAACTTCGGTGGGAAGGAGATGTCCGTGATT<br>GACTATATCAAATCTGACGACAAGTACTCTCAGGAGGCATTCGATGCTATTGACCCTGATGAGCCGCTTGCCCGCGTTAGATT<br>CCCGTGGAGCGATGACCCAGTTGATACAGCCCCGTCACTGCTGCACCCTCTCCCTAACGGTATCGAACCTAAAATGACCGGTT<br>ATGCCGCCAGAAGTGCCGACGAACGGTGGCGCGACACCGAACGCTTTGCTAAGCGGATTGATTACGTTCAGGTGTTTGACGAA<br>CAGTGTAACGTCTCCGATGAACCAAGAAGGGGCGGTTCTGTCCACGATTATCCGTCTCTCAAGTTCGGCGGCACCGAAGTTCT<br>TAACCTGGGGCAGCAGAATCCACTCAATACCGACCAGACCGTGAATAGACAGAATTGGAGGTATCTGGTGCGCGACTTCCTGG<br>AGGAGTACGGACCAGCTGTGAGACAACGGGGCGCTGCCCAGATTGATGTTGTTCATCCGGACGGTCGAAGCGATATGGCAGCA<br>GAGCTCTTTGCCAATCTGTCTAAATACCTGGAGAATTTTGTGGGGATTACGGTGCGGGACCAGCCCGGTATTGTGTCCCATAG<br>CGACTACCAGAAGCTGCGAGAATGGAGAGAACGGCACGCTGAGGATAGCGATGGAATCTTGGTACTTCAGGAGGACGGTTCAG<br>ATAGGTACCTTGACATCGTGGCGGAGCTGGAGGGGAACCCTACACAGGGGATTACCGTTGGAACATATGAATCATCACTTAGG<br>AGCAGTGGGTTCGATGACAGCATGTATAATATTGCCTGTGGGCTCGCCACCAAAATGGGAGTCAGACCTTTTCTGCTCGATCA<br>ACCTCTGAATGCCGATCTGTTTCTCGGTATGTCAGTGACCGGAGACGAAGTCAACAACGCCACAGCTGTTTTGGTGTCCGGAG<br>AGGATGGGGACTTGATTGGCCAGACCCAGACGAATCTGGCCACCGGCAGTAGCACTGTGACAGGAAAGGATGTTGCAGCTAGG<br>ATCGTTAGGCACGACAGATCAGTGCCGCCATCGACAGAAATCAACTTGGATACGTAGGAAGCTTGACAATTCATCGGAATGGTCA<br>GTTTGGGGACGGCGAGCTGGAGGGCATCAGAGAGGGCATCGCTGAACTCCAGTCCTCCGGTGATCTCAACGAAGAGTTGACTT<br>GGCAAGCCATTGAAATATCTGATGGCAGCAGCCATAGACTGTACACTGATGACTCCGGAAGTATGGTGCAGACGGGCAGTGTG<br>ATGCCACTCGACGATAAGAGCGTTACAGTGGTTACTTTCGGCTCCCCACACATCCATCAGGCAACCCCTGACCCACTTTATTG<br>CACCATTGCTGACGGAGAGGGAGAAACTGATATCAACCTGATCGGCACTGACATTCTGTCCTTGTCCTTTTTGAATTGGGGCT<br>CCCCAATGATGAAGATGAAGCAACCACTGACCACATACTTGCCAGCCGAGATGCATGACATTCTGTCAACCGGAACTCAACTG<br>AATCACCCTCCTTTTTAGTAA |
| 60 | ATGCCTAAAAAAAAACGGAAGGTTGAGGATCCGAAAAAAAAGCGAAAGGTGGGCAGCGGCTCTATGAGCGATTTTGACCCTAA<br>TGAGAAACAGGGAAGACTGATCGAGAGCACCGATGGCTTGCACCTTGTTGATGCAGGAGCAGGTACCGGCAAAACTTTCACTG<br>TAACACGGAGATACGCCACAATTGTCGAACAGTCTGACGTGGATCCTGCTGATATTCTCTTGGTGACTTTCACAAACAATGCC<br>GCCGCCGAGATGAAAGAGAGAATTGTGTCCCAGTCCGAATATGGGATGCGGGAGCTTACCGACGCTCCTATTCAGACCTTCCA<br>CTCCCTGGCAAACGACCTGTTGGAGGAGCATGGGCACGCTGTGCCTACGTATCTCGGTATAGATGATAGGATCACAGGGTCTA<br>CACAGATCCTGGAGGATGAGCTTGTCGAGGAGGCACTGTTTGACGAATTCATAGGGCAGTTCATGGACACTAACCCAGAGTAT<br>AACAGTTTCTTCACTGCTATCAGTGATACTACGGAACTCCTGGACCTGATCAAGGAGCTGGCAGCTAAAGGTGTTTTCCCCAC<br>CGCCAAAGGCTGGTACAGGGACGGTGAATCCCACCTGGACGGCGACTTCGAGGCTTTTGAAGACCTCTTCGAAGAAATAAATG<br>AACCAAGGAAGCGGGGTCCAAGCAGTCTAGACTCAGGGCCAAACTGAATAAGTACGGAGAGAATAAAGCTTATCTGCCCGAG<br>GCACCAGAGAGATGGGAAATCAGAGACGGCGGCAAACAGGTCCCAGATACCGTGGCTAGGCGCGTTTTCGAGGAAGACAGGGA<br>GGAGTTGAAGACATTCATTCACGACATGTACCACGCTTATCTTTCCTTCGCTCTGAGGAGAAATTACCTCAATTTCTCTTTCT<br>TGCAGCTGTTCGCTTTTGTACTGCTGTGTGAGGACCACGAACTGCGGGAGGAGCTGGGCTATGAATATGTAATGGTAGATGAG<br>TTCCAGGACAGTAGCGAGATCCAGTTTAAGCTCACTCTGCTGTTGGCAGGTACCAACAATATCTGTGTGGTAGGGGATTGGAA<br>GCAGTCCATATATTCATTCCAATACGCCGACGTCGATAACATAAGGGAATTTGAAACTCGCCTGGAACGCTTTACTACAGAAC<br>TTAATAATGACTATGACAGGATCCAGTACCCCACAACTCCCGTGACCAAGCTGGAACTGGACACAAACTACCGGTCAACCCAG<br>TCAGTACTGGACTTTACGGAACACGCACTGACGACACCTGCCACATCCAGCGAGTCAGTTGATGTGGATGCCGTGAGGGAGAA<br>GATTACCTCCTTGACCGCTGACGCTGATTACGATAACAGTATCATCGAAGCTATCAGATCCGATAAAGAGCACGAGGCCATTT<br>TGACGAAAATCGATGAACTCACCGGAAATGAAAGCTATGCTGTCGAGAAGGACGGGGAACTTAGAGCCCCCCACCTATTCAGAT<br>ATCGCCGTGGTAACACGCACTAGGGATTTTGGCAGAGACTTGTTGGATGTTGCAGAGGAATGTGGCCTTCCTATGGCTTATGA<br>GGGCGGGATCGAGGTCTTTAGAACCGACGCGGCAAAACTGCTGCTGGCTTGGTTCAGGATACTCGAGCGAGACGCTGATCGAG<br>GGTGGGCTTTGGTACTCGAGGAAGCGGGATATACTATAGACGAGAGCAAAGCCGTGCTGAAGAACGAGGCCTACCCAGAGATG<br>ATGATAGGCTTCAGAGAGGAGCTTAGGAAGCTGGAGACCTTCGGAGGGGTTGCGCGCCGGGTGTTCGAGCGGTATGGCTGTGA<br>AGGTCCTACCGCTGATGTGGTCCTCCATACTGTGCAGTCTGTGTATGAGGCGACCACACTGACTCGCGGGGACCTGATCCGGT<br>TCATAGAAGACGCCATTGAGTCCGGAAGCACACACGAAGTCCAGGCCGGCGCAGGTACTAACAGTGTCACAGTTCAGACTATT<br>CACGCAACCAAAGGCCTCGAGTACCCAATCGTGATTCTGGCGAACATGAACACCAATAAGTTTCCATCCAGTGGTGGATCCGG<br>CACCGATATCTCATACGACGATCCCATCGGTTTGAGAAGACGCAAACTGTACAGTGAGGTTGCCCATGGGGTCCCATACGTGT<br>ATGACAATTGGAAACTGGACGTGCTGAGACGCTGTCTGCCCCGCGAATATGACGAGGAGGAGGCTCCTGTACGTTGCTATT<br>ACACGGGCTGAAAACCACGTGGTTTTCACTGCTGGTGAGAATCCTAACACTTTCCTCGAAGAACTGCCTGTGGATGTCGAAGC<br>GGTCAATCCGGACTTGTCAAGTTTCACACCTGAACCGGTCGACGAGAGCCCATTCGAGGTCGAGATCTCTGCCTCAGAAGGGT<br>CTCCGCGCTTTTCCCCTCATACGTTTATCGATGACGCTGTGTTTGACGACGGAACAGGGGGAAGAGGTATGGAGTTCGGTTCT<br>CAGGTGCACGACTTCGCTGAGGCATATGTGCTTGGGGAAGATGTCACCAGTTCCTCCCCCTTAGTAA |
| 61 | ATGCCAAAGAAGAAGAGGAAAGTGGAAGACCCAAAAAAGAAAAGGAAAGTGGGATCAGGCTCTATGCACGATGATCACGACAC<br>CGACCACTCCCAGACTGACCTGACAACTAACCCCAAGGACAACTCTAACAACGGGGATATTGACATCGAGACTGACATTCTCC<br>AGCTTACAGGGGAGGACCTCGAATCTACCTACCCTAACAATCGGTACTTCGGGCAGGTTCACGAAAACTTCGAAATACCCGCT<br>AGAGAAGAGCAGACAGTTCCCGCTGGCGACGTGCTTCCTCCTAAAATTGCGCAAAACCTGGAGTTCAACCCCTGGTCCCATCA<br>GGCGGAAGCCTTGCAGGTTCTGGATCGGGGCGACAACGTCTGTGTGGCCACCTCAACTTCTAGTGGAAAGACCTTGGTGTACG<br>GTCTGCATATCGCCAGACAGTATTTGGAAGACCCCGAAACACGCAGCCTGATTGTCTACCCTACTAAGGCTCTGTCTAGAGAC<br>CAAGAGCAGGAATTGAACGAATTCCTGCGAAACACGTTGGGGCTCGACATTTCCGTTGGCGTGTACGATGGGGACACCAAATC<br>AGAAGAGAAGAGCCGGATCAGGGATGAATGCAACGTGGTGATAACCAACTTTGTGGGCCTCAATCAGTATCTGGAAAGCCACC<br>ACCTGTGGGCAGACTTCCACAGCAACTGTAGTCTGGTTGTTATTGACGAAGCGCATATGTGGACCGGCCTCGGAGGTATGCAT<br>GTAGCCTGGATTTTGAGGCGAGCCCAGCGGATAATTGACTACTATGGAGGCGATCCACAGTATGTGCTCACTACCGCAACGAT<br>TGGCAACCCAACAGAACACGCATTGGCTCTCACAGGCGAGCCGGCTGCGGTCGTCGACGAGGATGGAAGCCCACGCGGAATTC |

TABLE 16-continued

Nucleotide sequences for Optimized Ago Helicases

| SEQ ID NO | Sequence |
|---|---|
| | GGCATCTTGTTTTTTGGGACCCACCAATGAGCGGGGATGACGGATTCACTGATGATATAGACTCCCCAGCTCTGTCCAAGCGA<br>CCAGCAACAGTGGAGGCACCTGAAGTTTGGGCTCATATGTGTCAGAAGAACGTTCAAAGCCTCCTGTTTTGTGACAGCAGGAA<br>GCTGACAGAGTTGAGCGTGAATAGGGCGAAGAGATTTATATCAGATCCTAAAAATCGGTATCAAGGACGGCCAGACCTTGCTT<br>CATATCATGCTGGACATGGAAAGCAATCCCGGAGAGGGACAGAATACCAGCTTAAGGAAGGCCAACTCGACGGGGTGTCAACG<br>ACATCTGCCTTGGAAGTCGGCATTAATATCGGGGGGGTCGACGGCACCGTCTTGATGGGTTATCCTGGGTCTCGACAATCATT<br>CTGGCAGCGCATCGGGCGGAGCGGTAGGGGGACAAGAGACGCGCTGTCTGTTTTCGTGCCCTCCCACTCAACCTTGGATCAGT<br>ATATCCTGAGACACCCAGAATATGTCCTGGAAGAGGATCACGAGTCTGCCGTAGTGGATTTGGACAACAACCCAGTTTATTTG<br>CAGCAGTTGAATTGCGCAGCCCAGGAATTGCCCCTGACACGGGATGACGCTGAAGACTTCGGAGGGGAAGAACGCTTGGAGCG<br>GGCAGTCGAATATGGCAGGAGAAAGGGTGACCTTGAGGGCTCCCTGGACAGTGGAGTTATGTACGCACACCGCGATCGGCCTC<br>AGGACGCAATCTCCCTTTATAGCTCAGGAGGTAACACCTTCGACGTGCGACTGGCAGGTGATGGATCTATTGATCATCAGCCC<br>ATCGGGAGGGACAGGGCATATCGCGATTATCACGAGGGGGCCACAGTGCTTCACCAGGGCGAGCAGTACCAGGTGGTTGAACT<br>GAGGGAGGACATACCCCAACCTTACATTTCACTTGAAAAAGCGAATGTGAGTTATTACACCCAGTCACAAGGACAGGTAAATA<br>TATATGACACTGTTGTGGAAGATAGTAGAGAGGTAGGGCCGTTTACGCTTAACTGGGGATACGGGACAGTTTCTATCCACTAT<br>TCCACTTACCTCAAGCGAGAGATTGGATCTGGCGATGTGTTGGAGCTTGGGAACGAGACCGGGGTGCCTCCGCTCGAGATGAG<br>AACCCAGCTGTGCTGGGCCGAAACCCCTAATGACATCGAGAGAGCCATGTTGAACAAGCATAGTGAGTATCATAACCCCGAGT<br>GTATTAACCTCCCACCTCGGCTGCACGGCTATCTCGGAGGTATTCATGCTGTTGAGCACGCTATGATCGCCGTCTCTCCACTC<br>GAGTTGAAAGTGGATGGCGGAGATATCGGCGGCCTGGCGACAAACCGCCTGCCCGGCAATCCTGACAAGTCAGGGTGGTTCAT<br>CTATGATGGAATCGAAGGAGGATTGGGGTTCTCTAGGAGTATTTATGAGCACTTTGAAGATGTCGCTCGAAGAGCTCATGATC<br>TGATTGTTGACTGTTCATGTGGTCGGGACGAGGGGATGCCCAGCATGCACAATGGATGATCGCTGCGGCAATGATAATAGGCCA<br>CTGTATTCACCAGCTGCCGCCGACGTGATTGAGCATCTGCTCGGCGATCAAGAGGAGGACGACCTGAACGAGCACCTCCCCGA<br>GACAGGGTCTGAAGTAACTCCTGTGGAGGAACAACGCCCACCTGCATCAATATCTTAGTAA |
| 62 | ATGCCCAAAAAGAAGAGAAAAGTGGAGGATCCAAAGAAGAAAAGGAAGGTGGGGTCCGGGAGCATGTCCGAGCTGGAGACTAA<br>CATCTTCCCGATTACTAACCTGCACGAGTTGGAGTCCCGCTTTAGGCTGTACAGGGTTAGAGGGTTGAGCATTAATCAGGAAG<br>AATACGATCCCAATACCCAGACCTTGGTTCGGAAACTTAGTTACAGTATGAGGTCACCGGTTGCCGTAATCCTCAGAAACAGC<br>GACCCGTTCCTTGCCCTGCCTATCGATGCTCCAGAACCGATCTCCCCCTATCCACTTGTGCGAGCTACCGCCGTTTTCGAGAA<br>AACGGATGAAGTCTTTACGTTGGATTACGAAAGCCCTACTCCTGAAACTGATGCACTGAGGATCCGCTTTCTTCAATTCATAA<br>TTCAAGGAGCTCTTTTCAGGAATCCCAGTCTGTGGCAGCCCTCAGCAGGGACACCCTTTTTCGAAAGGAGCCCGGTCCTGGAG<br>AAGGCAGGGATTTGCGCATACCGGGCTTCAGTGTACGGGTCGTCCCCATTGAGGGGGGGTAAGCTGGGGATATGCGTTGATGT<br>CAAGCACAGATATGTGTCTAAGAACCCCATAGAAGCCAATATTAAGCGGGAAGAGTTTCGAAAGTACAAAAATGGCCGATGTA<br>TTTACCACTATGGACACAACTGGTATGAGATTAAGCTTCAGGACCATACTGGGTTGAGCGTTTCCGAACAAATGATTTCAAAT<br>GGCACCGCCAAGCCAATTTCCCTGTACCAGTTCATCATGAACAATGCTCCTAAGCCTCTCCCTCGCGAAGTGATAGACATGCC<br>CCCAGACTCTCCCGCCGTCAAGTACATGACCTCTCGCGATGAGGTCAGATATGTACCATCTATTCTCTGTTACCCAGTGTTCG<br>ACACATCAGACCCACGCGTGAAACCTACCCATCGCGGTACCATCCTGCTGCCCAATGTAAGGAGACAGTACATTCATAATTTT<br>GTGAATTCCCACCTGACGGACGTGAGAAGCAAGGATATGGCCATCAGGATCAGCTCTAAGCCAGTGATCGCCCCCACAAAAAT<br>CTTCTTGCCCCCAGATCTGGCGTTTGGTAACAACACCGTGTTCAGCGTCCGGGGTACTCCCGGGACGACCTACGTGAGCCTGG<br>AGCAGCTCGGCCAGACAAGGATTTCAGCTCTCTTCAACCAGAAAATTGAGCGCTCCTACGATAGTAGACCTCTCGACAGGCAGTAT<br>ATGATACTTCCCAAGTCCGTCTGGGACTCACACGGGCCCGTCTTCCTGAACGACTTTAAGAAGATTATGAATGAACTGTACTT<br>GCACGAACTTCCTTATAACCCTATTGTGGTGACCTATAATGATCTGAGTGCTAAGACTTACGCGCTGCAGGGGAGGGCAATTC<br>TCGACGCCGTCGATAGCGAATTGAGGGAGCCAGGCTACGGCGTCGTCATGATACATGAAACAGTGGATAGAAGAAATCGCCAG<br>CATGATCAACTGGCCGCCATGGTTATGAGAGAACTTAGGAACCGGATGCTGACGTGAGCGTGATCCACACTACAGTGACCAA<br>AGACTGTTACCAGCTGCCTCAAAACGCTCCGATAGGCAAGGCCTACTGCCCTGTGGCCGGAAAGCAGGGTAAACTGAACGGCT<br>ATCTGAGGAATGTGGCCATAACAAAAGTTCTCCTCACAAACGAGCGCTGGCCTTTTGTTATAAGTACCCCACTTCATGCCGAC<br>TTCACCGTGGCCTTCGACGTGCAGCTGAATACCGCCTGCTTCACATTTATCGGGAAGAGCGGGAGTGACATCCGGACAGTTCT<br>CAAGACCAGCAACCAAAAAGAGCGGTTGAGTAAGGCTCAGGTGCGGCAAACACTGTTGGAGGTGCTGCGCCAGGAGGTCGGGCT<br>TTGGAAGGCGCACCATGCAGACTATAGTGGTTCAACGAGACGGCAAGCTGTTTGCTAGCGAGATCGCAGGGGCGAAAGATGCC<br>ATCGAAATTGTTAAAAAAGAGGGCATTCTGCCCAGCGACGTCTCTCTGAACTTCATTGAAATCCCTAAGAGCAGCGTGGCCTCC<br>TTTTCGACTGTTCGATTCCTCTCCTCGGCCGGGACAGCCAGAAATGGCTAACAACCCACGGATAGGATCATACTTCATTGCCA<br>CAAACTACGACGGCTACATCTGTACAACAGGGAAGGAATTTTATCATCCTGGAACCGCTAATCCACTCCATGTCAAGTATATC<br>GAAGGTAATATGCCTTTCGAGAAGATTCTTGAGGACGTGTACGCATTGACATGTCTCGCGCTGACCCGCCCGAGGACTGCAC<br>TCGCGAGCCATTCACAATGAAACTCGCCGACATCCGACTGCGGGAACACGCAGGAGGGTACGATGAAGACGCGCTGGCCTACG<br>ATGACGAAAACGAAAATGACGAGGATAATGAAAATGAGTAGTAA |
| 63 | ATGCCAAAGAAGAAGCGCAAAGTCGAAGACCCAAAGAAGAAAAGGAAAGTAGGTTCAGGCTCCATGACGTTCACCGAATACAA<br>GACGGTGGAAAAAGAGATCCTGGATTGTCTGCAAACTGCGGAGCTTGGCTGGAGGTATGAACCGGGGGATGAAGTGACACTTA<br>AGTACCGGGCGGGGATGAGCAAGAGATGCTCCTTATACCCATACTGCGAGAGAAGCTGAAGGAACTGAACCATGGAGTGATC<br>ACCGATGACGAGCGGGCCAATATTATTCAGAAGCTGAGGGCCTTGAAAGACAACCAAGAGTGGATTAAATGGATCAGAGG<br>GGAGAAAACCTACAAGTTCAGCCAGGATGAACCAAGCAGGAATATAAACCTCATTGACTACACAGGTGTGGGCAACAACGACT<br>TCCTTGCTAGCAACCAGGTTTGGATTCAGGGAATCGAGCACAGGAGACCGGATATCCTGCTCTTCGTAAACGGAATTCCCGTG<br>GTGGACATCGAGGCAAAGACTGCCTCTCACGGCCATATTGATTGGGCTGAAGGCGCCAAGCAGACGGGAGATATGACAAAGA<br>AATACCCAATCTCTACTACTCCAACTGTTTCTGTGCCGGAGTGAATGAGCTGCGAATGAAGTATGGTATTCCTGGAGAACGAC<br>TCCAATACTGGCAGCAGTGGGAGAGACCCTTACCCACACACCCACATTCCTAGTTTTGACGAGATGAAGTGTACAATCTATGGT<br>CTTTTCGACCGGACCAATTTGCTTGATATTATTCAGAACTTCATTGTCTTCGAAACTGAACAGAGCAAGACTATCAAGAAAAT<br>AGCTAGATACCAGCAATTCCGCGCCGCCAATAAAATCGTGGCTAGAGCACTCAACCTTGATCAGGAAAGTGGTCAACGGCGGG<br>GCATCGTGTGGCATACACAGGGCAGCGGGAAGTCATTGACAATGTTGTTTGCCGCCCGAAAGTTGTGGAATGACTCCAAACTT<br>AAGCAACCCACTATCATTATTGTGGTGATCGGGAGCAGCTGCAGGATCAAATGATCGGTGAGTTGTTCAAGACCAATTCAGA<br>AAACGTCGCCGTAGCCGTCTCCATCCAAGACCTGCGCCGACTCGTTGCAGAGGGCGACGGTTACCGGGGCATCATCGTGACCA<br>TAGTAAACAAATTCGAGGGCATGCAGATCGAAATCAGCAAACGCGCTAACATAGTCATGCTCGTGGATGAAGCTCATAGGACC<br>CAGTACGGCGATCTCGGGATCTTCATGCGGTCAGCGATGCCCAATGCAAGTCTTTTCGGGCTGACGGGAACACCTCTCGAACT<br>CGACGATCGGAATACACCCAGAGCGTTTGGCCGCAAACTCGGGGAAGACAGATTCGAAAGGTACATGACAGGTATTCAATCG<br>AGGATTCCCTTAGAGACGGCGCCACGCGCCCTATCCATTACGGAGGTCCGCGCGACCGATTGGACGGTCGCTTACACAGACCTT<br>GACAAAAAATTTGAGGCTTTGTTCGCTGATCGCTCTCCTGAGGAACGAAAAGCGCTGATGGGCGAGGCTAAACTCGACGCCAT<br>CCTGAAACACCCTAAACGGATAGCACAGGTGGCCAATGATATTGCTAATCATTTCATCGAACACATAAGACCGAACGGATTTA<br>AGGCAATGGTTGTGTGCAGGGATAAAGAGATGTGCGCGCTCTACAAAACTGCTCTGGATCAGCTGCTGGCACCGGAAGTGAGC<br>CTGATCATCATCAGCGAGGACCCCACTCATGACGTCGACAGTATCAAACCGTACTACCTTGGAGACACACAAAGAAGAAATGC |

TABLE 16-continued

Nucleotide sequences for Optimized Ago Helicases

| SEQ ID NO | Sequence |
|---|---|
|  | CGTCGACGACTTCAAGAACCCTGCCCCCAAATCCCAAGAAGAAAGGGATAACCCCGATAACAGATTTAAAAGGGTGGAGATAC<br>TGATCGTGTGTGATATGCTGCTCACCGGATTCGACGCCCCGATACTGCAGGTCATGTACCTCGATAAGTCCATGAGAGATCAT<br>ACCCTTCTGCAGGCTATCGCCAGGGTAAATCGCCCATACTCTGAGTTGAAGGAGTTCGGGCTGATCCTGGACTATTTTGGGAT<br>GTTCGAGAAACTGAATGACGCACTCAACTACGATAAAAACGAGCTTGGGGAAGTGGCCTTTCCTTACGGTAAATTCAGGGATA<br>TGTTCAGAACCAATATAACGGAATTGCTGGACCTCTTCATCGGGATCCCACACGATGGCTCCCACCAGAGTGCAATGCGCGTT<br>CTGATTATGTTGAACGACAACGATGAGAAACGCGAACAGTTCGAGAAGCTGTTCCGCAATGTTAGGGTGCTTTTCGAGACTCT<br>GCAGCCAGACGAATTCTTGCGAGACTTTCTCTATGATTATGAGTGGCTGTGCAAACTGTACATGATCTACCTTAAAAAGTTCT<br>ATCCAGCAGAGCACTTTGAGATAAGCGAGGAGGACGGGGCAAAGACCAGACAGCTCATTCGAGAGCACGTGGATGTTAAGGAG<br>ATCGAGGAGGAGTTCCCGACCTACAAGCTGGATGAAAACTACTTGACTAAAATAAAAGATATGAATCCCAATGCCAAAGCACT<br>GGACATCGAGGCAATGTTGGACGCTGAGATTAGGATCAGGCTGGATGAGGACGAAGACGTGCGCCCACTGTCTGAGCGCCTTA<br>AGCATATAATTGAGCAGAAGCGGGCAGGAACTCTCGCAGGGATAACTCTGCTTAAAGAGCTGGAGGATTTGACAAAGCAGGTG<br>GTCGATGTAATCCAAGAAACCCAGCGACCTGTGGTGGACTCTATTGCAAAGGAGGTCGCGAAGCGCGTACCGAATATCCCGCA<br>GGGCGAAGCAATGGCTGTTGCCCAGGCTATCATAGCTAAGGCTAAGGAGAAATGCTTCGAGAACTGGTTCTTGCGAACTATA<br>TGGACACTGAGCTGTACCGCGAGTTCACCATTTTGCTTGCAACACAGTTCAAGAATCTGCAGCTGCACGGTGCAGGCAAAGAT<br>TTCGTAGAGAGGTGTATACGCCTCTTGAAAAAGGCGAGGTTTGCCGGAAAGGATAAGTAGTAA |
| 64 | ATGCCAAAGAAAAAGCGGAAGGTCGAGGACCCTAAGAAAAAGAGAAAAGTGGGCTCCGGGTCAATGAACATTATTCTTGATAA<br>GTCTGTAGAGCTGTTGTTCGTCTTCATTTGTAAAACAGTGATTTTTATCAACTATTACACACGCAACTACTATTGCGTTTACC<br>CTATTACCACCGATCTGCAGATAAATGTTGTCAACAATATGGAAGAGAACTGGCATTACACAAATTCCTTTCTTATCAATAAG<br>CATTTTATCGATATTGTGTCTAAAAACTGTGTTCGGATTGTGTCTAAGATCAATTACTTGGATAAAAAGGAGGATATCGAGAA<br>GCTCCTGCACTCCATCGCTGCCACCCTGGGCGGAGTCTACATCGAGGATTACAATCCCTTGAAGAATGAGTTTAGCTTTTACA<br>TATGGAAGAGAATCCTGAATAAAAAGATCAAGGATCTGAAAAGCGAGGAGCTGGAAAAACGGATGGAAGATCTGGGCATTAAA<br>GACATAAAAAATAAGACCCTTCTCGATTACGTTACTAAAAAGTACGAGAATGAAATCAACTTTAAGATCATTAACGAGGAAAA<br>AGTCAATTGGAACGAGCTTAACTATGAGATCAAGGAGAAGATTGTGCTTGGAGCCATAAAGGCACACCCAGCGATCCGCAAAC<br>TCATTGAGTACAAAGAGGAAGAACTGTTGGAGGACATTGGGCAGAAGATCCTCACTTATTTCACCATCACCGTCGAATCCGAC<br>GAAAATGAGAATTATTTCCTGGTGGTCATGCCCAAACATCGGATCATTAGCTCCGAGACTATCTATGAAATGCTGAAGTCAAA<br>CAAAATTGACATTAATAAGCTGAAGCGGGACCTGCTCGGGGGCAGCGTCTTCATAACAACATCCCGGAAGGGCGTTCGGCGGA<br>AAAAGGTGAAGATTAAAAAGATTATCAGCCCCAAGGAGCGCAGGTATCGGAAGTACGTTGAAATCATTAATAACTACTACAAG<br>GAGAAGGGTATTCCTATCAAGGTCGGGGGTGAAGACATCCACTGTTATATTCTCGGAGAAGAGAAGATTGATGTTTACCA<br>CACTAAGAATGCACTGCTGTACAAAGGTATCGACGAAAAAACCCAGAAAATTATACTGGATAAAGGCAAGTTTCTGCACGAGC<br>TCGAAACCGCAAAGCAGATTCTGAGCAAATACGGCAATCTGATTGACTTCGACGGTGAGTTCTCTAATATCCTCACTAAGGAC<br>GGCTACGTGATGACACAGCTGTCTACCGTGCCCAAAATAAATATCAAGCTGAGAACTAAAAATGGCATCAAAACCTACAATTA<br>TCTGAAACTGATGTATCTCTTTGATTGGATTTTCAATAAAACCCTGAACGACCGGGAAATTTTCCTCCCGCTTGTGATTCCCC<br>CAATGTTGAAAGAAAAGGAGAAAATAGGCATTTATATCTTTTATTCCAACATCTCCGATGTGGAGCTGAACTTCATTAAAGAC<br>ATTTTTCCGGAAGCTCTCAATCCTGCACAAACTGGATAAAAACATACCAAAGATTGAAATTAAACTCGAAAAGGAAATTGATTT<br>CGAGGATTACGCTAACTCTCGGGCGATTATTACCCAAACTGTGCTGAATAATTCTGAGGAGAAAGAACAGCCCTTCCTCATCT<br>GTATCTCTCCAAAGCTGCCAAACAACGAGTTTGACGAGCTGAAGCTTACACCTGTTCTCATACCAACAACTACTTTCCATCAA<br>TTCATGTATCCTTTCAATCTGAAAAGATGCTTGAACGACGACGACTTTAAAAAACCCTTCATTAATTCAATCCTTTCTCAGTT<br>CTTTCACAAGATGGGCATGTACCTGTTTAGTTTCTCCGAAGAGCTGGGAGACTACGACTTCATCATTGGGTACGACATCACGA<br>AGGAAAAAGACGAAAATGATAAGATCAAGGGTATCGGGGGATCAGCTATCATCTACAACAGCCATGGCCACGTAATCACCACC<br>GTGACCTTCGAGGACGTACACCCTCCAGCGAGATAGCTAGGTATGAAGGCTCTTTGCAAAGGTGTATGCGAACTGGTTCC<br>CCACCTGAACTTGAATAATAAGAGGAAGATAAAAATACTTCTGTTGAAAGACGGCAGAATCTTTAAGAAGGAGTTGGAGAAAT<br>TGTCTCTTATCAGCAAGAAGTATGGGTTTGAGATAATTTACATCGACGTGCGCAAAAGCACTAAGCTGCGCTTTTTCGACATC<br>AAATCTAAAAAAGCTGTACCCGAAGGTAAGAACGCATATACCAAATTCGGTCGAGCCTATTATGTGAGTAGTCACTACTATAA<br>AAGGTTCCTGAAGCAGCCCATCAAGATTGTCGAGAAGTACAGGATCGATGACGGTTCTTACAAGGGAGTGAAAATAGAGGAAA<br>AGGATATAAAGCAGCTGATTCTTCTCACAAAAATCAATTTTAGTCAGCTGATGCCCGATAAAATGAAGCTGCCAGCCCCAGTC<br>CACTACGCTCATAAACATGTCAATGCGGTGCGAAGAGGCTGGAAGGTGGATGATAAGACTATCCTCCGGAATGGATGTCTGCC<br>TACTATCTAGTAA |
| 65 | ATGCCCAAAAAGAAACGGAAGGTGGAAGATCCCAAAAAGAAACGCAAAGTCGGAAGCGGGTCCATGGACTTGAATGAGTTCAT<br>GGAGATCATCCACCCAATGCTGCCTTCCGGCGGGCTGGATGAAAACCAGATGAACGTGGTGATACATGGCAGGGACCATTGT<br>GGGTGATTGCCGGGCCTGGAAGCGGCAAGACCGAAACCCTGGTGATCCGGACTCTGAAACTGATATTCGTGGACAACGTGAAT<br>CCAAAGAGTATTGTTATTACAACGTTTACAGAGAAGGCGGCCAAGAATATAAAGGACAGAATCAGCAACTACGCCTACCTGAT<br>CTATCAAAAGTACCCAGAACTGCAGCGGAACCTGGACGTTAATGATATCTACATAGGTACTTTGCACTCCCTGTGCAACCAGA<br>TCATGCTGGAGTACAGATACCCAGGGTATGAGAATTATAGGCTCATGGATGATATTGAACAATACCTGTTCGTCCATGAGCAC<br>AGCGACGCTGTAAAGCATCATCACAAATACCAGGATATGTGGAATCACTTTAAATACTTGGAAAACAAATGGAACCGCAGTTT<br>CAACTTCCAGATGGGGGAGAACCCAGGTGGCCACAACCCTCTTTAACCGGATCGTGGAGTACCTCATAGACATAGAGGAACTTA<br>AGCAGAGCGATGAGAAGTGGGCTGTGCAGCTCGCAGACCGTTATGAGAACTACGTCCAGCTGCTGGAAATCCACCATAGGTGC<br>GACTTTTCCCATCTCCAGAGAAATTTCTGGAATTCCTGAACACGAAACTGGGCGAGTTGTTCATTAAAGGGGATGGTTCTCT<br>GAGACACCCTGGGATTTCCCACGTACTGGTCGACGAGTATCAAGATACGAACCCCATCCAGGAAGCCATTTACTTCAAAATGG<br>CCGAGAATACCCATAACCTGTGTGTAGTAGGAGATGACGACCAGGCGCTCTATCGATTCAGAGGCGGAACTGTGGAATGTATG<br>GTAAATTTCGGGAATGCTTGTCACCGCGAATGGGGCATTACCTTCAAGAAGGCTCTGAACAAGGTCGGGATCGTAACCATACG<br>GTCCCATAGGGAAATAGTTAATTACTGTAACAAGTTTATAACTTCTTTCCCTGTGATGCAGAAGATCGGAGCCAGAGTGAAGG<br>ATAAACCTGAACTTAACCCCAAGTCCGATATTTCTGGCAATTACCCCGCAGTTGCCTACATTACAGGGCGGACCATTGAGGAG<br>ACAGCAAATAATTTTGCCAATTTCGTCAGGTACCTCCTGGACGAAGGCGTGGTGTCCAAGCCATCCGACTGTGCGCTCCTTAT<br>GAAATCTGTGCGCGAAAATCGCAATTGGGCGGAACCCTTCAAGAAGGCTCTGAACAAGGTCGGGATCGAAGTATACAACCCTA<br>GATCCAGGAAATTTCTCGAGCAGGAGGAAGTGATGGCCGCACTTGGAGCTTTTATCACCATTATTGACCCCAAGCAGAATGCG<br>CTCAGGAAGGTTTGCAACGAAAACATACAGAGACTGGTGAATCGCTGGGTGGACACATACAGGAATGTGGCATCCGAGAGCCC<br>GGAACTGCGAAAGTACGTGGACTGTTCTATCAAGAGCATCGCCAAACGAAATCTGGGTGAAAGGCTGAATATTAATATTAGCG<br>AGATCTTGTACAGGATACTCGCCCACCCCCCTTTCCGATTGGCTGGACGCGGAAGCTATAGGCTTGGGAAACTC<br>ACCCAGCTGTTCGAGAAGTATTCTTCCATCCCCTACGATACCCACGGGTCTACACGAGGACTCCTTAAAAGTCATCTAAGAA<br>TAACGGAGAAATTAGTTTCCGCTGGAGACAAAATTTTATAATTCTTTTATTGGACTGCTCAGTACTGAAGGGCTGAACGATC<br>CTGAGGATGAGGAAATTATCTGTCCTCCAGATCGCCTGCCGATTATGACCATCCATCAAGCCAAAGGTTTGGAGTTCCCCTTT<br>GTCTTCGTGTATGGCTTGCGGTTGAAGGGAGACAAGCCAAATGAGTCCGCAATTATAGAGGAAGACTTGTACAAGTATAGGAA<br>AATCAAGTATAGTATCAACTTTACCCCACTGGAAAGAACGCAGCAAGACCTGATCCGACTGTACTATGTTGCCTATTCAAGGG |

TABLE 16-continued

Nucleotide sequences for Optimized Ago Helicases

| SEQ ID NO | Sequence |
|---|---|
| | CTAAGTATGCTCTGATTCACCTTGTACCAAGAAATCATATGGGGTCAAAGGGCTTCGGGTTTATTGGAAATAACTTTAGCCTC<br>TTCTCTGCTATCGTGAAAAAAATCTAGTAA |
| 66 | ATGCCCAAAAAGAAGCGCAAAGTGGAAGATCCTAAGAAAAAAGAAAAGTTGGCTCCGGATCTATGCCAGTGTATCTTAACCG<br>GTTCCTTTTGGACCACCTGACCTCACCTCTGTCATTGCCTGCCTTTCGAGTTGAACTTGATCCCCCTCCATCAAAGGACGAAG<br>TCCACCCCCTGCTGGCGCTGGTTGGACGCGAAGCCGGTGGGTTGGTGCGGTTTCAGAACAGGCTCATCGGCTGGGAAGCACCG<br>CGGGCACTCGAGGGACAGGTGCGGCGGGGTAAGCAGTCTTACAGACTTGTGCCCCTGGGAAGACAAGCACTGAACCTGCCGAA<br>GCCAGAGGAACGACAGGCTCTGGAGAATCTCTATCGGATTAGACTCGAGAATATCCTGAAAGCTTTGGCCAAGCGCCACCGGG<br>CCAGGGTGGAGCGCCGGGGCAATGGACTGTTCCTTTGGCGGCCCGAAAATCCCCGAGAAGAAAAAGAGGGGTGGCACTTGTAC<br>AGAGGATCCCTGTATCGCATCCATCTTTACCCAGATGGCGAAGTGATCCTCGAGGTGGATGTCCAACACCGCTTCCAGCCCAC<br>CTTGCACTTGGAGGAGTGGCTTCAGCGGGGTTACCCTTTGCCACGCCGAGTTACAAACGCATATGAAGATGAGAAAGAGTGGG<br>CTCTTCTGGGGATCGAGGAAGGGAAGGACCCACGCAGTTTTCTCCTTGATGGTGGGGAGTCCCTGTTGGATTACCACCGAAAA<br>AAGGGCCGGCTGGCCGAAGGACAGGATCCAGGCAGAGTTGTATGGGTCGCCCGAGGAAAGGAACGAGAACGCATCCCACACCT<br>GTCTGTCCTGTTGAAGCCAGTGATTACTATGGAACTGCTGGCGAGGTGGCTGAAGTGACCCAGGAAGCTCTCCCTGCCCTGC<br>AGCTGGAGCCGGAGGAACGACTCAAAGACATCAGGCGATTCGCTGAGCCCGTCTTGCAGGCTTTCGGAAAGCGCGAGACTGCT<br>AAGCCGCTTGAGGGTCGGGCCCAAAGGCTTCCAAGACCATCCCTTCTCGCACGGGAAAAAAGCGAGTCGGCAAGGTAGCGGA<br>CGTGCTGGAAAAGGGAGCATTGAGCCCAGGGGAAACCCGACTCGCCCTTCTTGCATGGGAAGGCGACGGGAAGGCTAAAGGGG<br>GACTCGCCTATCTCGAGGAGCGCCTGCAGGGCGTGGGCTCAGCCAGCGGAATCAAACTGGAGTTGAAAAGAAGATTTCTCCCT<br>AGAGGGGACAACCTGGAGATGGCCCAAGTCTTTGAGGAACTGTCCCAAGAGGGTGTCGGAGCCGGGCTGTTGCTCACTCCCAG<br>GCTCACCGAAGGCGAAAGACGAGAGCTGAAGAATACGGCCGCCTCACACGGTCTGGCACTTCAGCTCCTTAATCCATTTGACC<br>CTGGAGATATCTACAGAGTTAACAACGCTCTGCTCGGCTTTCTTGCAAAGGCGGGCTGGCTGTTCCTCAGGCTGGAGGGGACA<br>TACCCTGCAGATCTGGTGGTGGCCTACGATGCAGGGGGGGAGTCCCTGAGGTTTGGCGGGGCGTGTTTTGCACACCTGACAGA<br>CGGTACACATCTGGGTTTTAGCCTCCCGGCCGCCCAAGGAGGCGAACGGATGGCTGAGGAAGTCGCTTGGGAACTCCTTCGCC<br>CTCTGTTGCTGAGATACAGGAAGGCGAAGGGACAGACTCCTGGCCGGATCTTCCTGCTGCGGGACGGCAAAATCCAGAAAGAA<br>GAGTTTCGAAAGGTTGAGGAAGAGTTGCGAAAAAGGAATATTCCATATGCACTCTTCTCTGTTAGGAAGACAGGAGCTCCACG<br>GCTCTTCAGCAAGAATGGACCCCTTGGGGACGGCCTTTTCCTGAGGCTTCCAGAGGAGGAGGGTGGATTCCTGCTCCTGAGCG<br>CCGAAGGCGGGAAGGGCACGCCTAGGCCTGTGAAATACGTCCTGGAAGCTGGAGAAGTAGACCTTA/TCTGGAGGAAGCAGCT<br>AGGCAGTTGTATCACCTGTCCCGCATATACCCGGGCTCAGGATATCGGTTTCCCAGACTGCCCGCGCCCCTCCATATGGTTGA<br>TAGGATGGTGAGGGAAGTGGCGAGACTGGGCGGGTCCCACAACCTGCGGCTGAAAGAGGAACAGCTCTTCTTTCTGTAGTAA |
| 67 | ATGCCAAAGAAGAAAAGGAAAGTGGAAGACCCGAAGAAGAAGCGCAAGGTCGGCTCTGGGAGCATGCATCCTGAGGGAGCAGA<br>CCTGATCCAAAGAAACCGGGCAGTGCACCGAATGCTTGTGGATGGCGTGACTGTGGAGTATAGGACCTCCGAGGGGGCAATCC<br>GGGGGGGCCCAGGCGCGGGTCATAGACTTCGATGATCCAGAAAATAATGATTGGTTGGCAGTTAACCAGTTTACTGTGGTGGAG<br>AATCGCCATCGGCGCCGCCCAGATGTCGTCCTTTTCGTCAATGGGCTGCCACTCGCAGTGATTGAATTTAAGAACCCAACCGA<br>TAAAAAGGCAACAATATGGAGTGCATACAGGCAATTGCAAACATACAAAGCCGAGATCCCCTCCCTGCTCGTGTATAATGAGG<br>CCCTGGTGATTTCCGATGGATTGGAGGCAAGGATCGGCACGCTGACCGCAGACAGAGACCGATTCATGCCCTGGAGGACAATC<br>ACAGGCGAAGATGTGGCCCCAGCCGAGATGCCCCAACTCGAGGTCCTGTTGAAGGGAGTGTTCGAACGGCGAAGATTTCTGGA<br>GCTGGTGCGCGGCTTTGTCGTTTTTGAAGACGAAGGGGGGGGTAAACTGGCCAAAAAGATGGCCGGGTACCACCAGTTCCATG<br>CTGTGAGAGTGGCCGTCGAAGAGACACTGCGGGCAGCCGCCAGATATGAGGCAGGACGCCAACCTGGGGGAAAACCCGGCGAC<br>CGAAGAATAGGGGTCGTCTGGCATACCCAGGGCTCCGGCAAAAGCTTGACCATGGTGTTTTACGCCGGCCGCATAATTAGGCA<br>TCCCCGAATGGAAAACCCAACTATCGTGGTACTCACAGATCGCAATGATTTGGACGGACAGTTGTTTGGTGTCTTCTCTCGGT<br>GCCGCGAACTTCTCGGGCAAGATCCTATCCAGGCCGAAAGCCGCGCCCACCTGCGGGAGTTGCTTCAGGGGCGGCAAAGTGGA<br>GGAGTGATTTTCACCACAATTCAAAAATTCCTCCCAGAGGAGAAGGGGGATCGATACCCACAGCTGTCTGATAGGCGCAATAT<br>CGTTGTTATCGCCGACGAGGCACACAGGAGTCAGTATGATTTCATTGACGGTTTCGCTAGACATATGAGGGATGCCCTGCCGA<br>ATGCTAGCTTCATAGGCTTCACAGGCACACCTCTCGAGCTGGATGATAGAAACACCCGCTCAGTGTTCGGAGATTACATTAGC<br>ATATACGACATACAAAGACAGTGCTTGACGGCGCTACCGTGCCAATCTACTATGAGTCAAGACTCGCCAAACTGGACCTTCC<br>TGAGGAACTGAAGCCAAAAGTGGATGAGGAATTTGAGGAAGTGACCGAATCCGAGGAAGTCGAGCGAAAAGAGCGCCTGAAGA<br>CAAAGTGGGCCCAGCTGGAAGCGGTAGTAGGGGCGGAAAAACGGCTGAGACTGGTGGCCCAGGACATTGTGACTGATTTCGAG<br>CAACGCCTGGAAGCTCTGGACGGAAAAGCCATGATTGTATGTATGTCCCGGAGGATTTGTGTTGAGCTCTATAACGAAATTGT<br>TAGACTGCGCCCAGCCTGGCATAACGATGGGGATGATAAAGGCGTGATCAAAGTGGTGATGACCGGAAGCGCCTCAGATCCAG<br>TTGAATGGCAGTCCCATATTCGGAACAAACAGAGACGGGAATTCCTGGCCAAAAAGCGCTTTCGCGACCCTGCTGACCCCTTT<br>AAGCTGGTCATTGTGCGCGACATGTGGCTCACCGGGTTCGATTGCCCTTCCCTTCACACTATGTACCTGGACAAACCGATGAG<br>GGCTCACGGCCTCATGCAGGCCATTGCCAGAGTCAACCGGGTGTTTAGGGACAAACCTGGTGGCCTGGTGGTCGATTATCTGG<br>GACTCGCTCACGAACTGAAAGCCGCACTGGCCACCTATCGGAGTCTGGCCGAACAGGGCGAACAGCCATAGATCAATCTGAA<br>GCTGTCGCCGTGATGGAAGAGAAATACGAAATCTGCCGAAACCTGTTTCACGGCTTTGACTGGTCCCTGTGGAAAACTGGCAG<br>ACCCGAAGAAAGACTCGCCCTGCTTCCAGCCGCCCAGGAGCATATTCTCGCGCAGGAGAACGGGAAGAGCGCCTCCTGCAGG<br>CCGTGAGTGAGCTGTCTAGAGCGTTTGCCCTTGCTCTGCCTCACGAAAAGGCACTGGCCATCCGGGACGACGTCGCATTTTTT<br>CAGGCCGTTAGGGCCGCCCTCGCAAAACGCGCCAGCTCTGAAGAGAGGACCGAAGAAGACTTGGATCACGCCATCAGACAGAT<br>TGTTTCTAGAGCTCTGATGCCCGAGGGGGTAGTAGATTTGTTCGCTGCCGCCGGCCTCAAGAAGCCGGGACATCAGCATTCTGT<br>CCGAGGAATTTCTGGCCGAGGTCAGAGGAATGCCTCAGCGGAATCTGGCTGTGTGGAGCTGCTCCGAAAACTGCTGGAGGGCAG<br>ATAAAGACGCGGCGCAAGAGAACGTCGTCCAAGCGCGCTCTTTTGCCGAAATGCTGGAACAAGCCATTAGAAGATATCCAGAA<br>TCGGGCCGTTGAAGCGGCTCAGGTGATCGAGGAATTGATCGCGCTCGCACGGGAAATGCGGGAGGCAGACAGGCGAGGACAGG<br>CTCTGGGCCTTAGTGAAGAAGAGTTGGCCTTTTTACGATGCATTGGAGACCAACGACAGTGCTGTGAAGGTTCTCGGCGAGCCA<br>ACTCTTCGCGAGATTGCAAGGGAACTCGTGGATACTGTCAGAAGAAACGTGACAATCGACTGGACCGAGCGAGAAAATGTGAG<br>AGCCCATCTGAGGCGCTTGGTGAAGAGGGTCTTGCGCAAGTATGGATACCCACCCGATAAGCAGGAGAGGGCAACCCAGACTG<br>TGCTCGAGCAGGCAGAGGTACTCTCAGAGCAGTGGGCCGCCTAGTAA |

TABLE 17

Argonaute nucleotide sequences containing 2X Nuclear localization sequence (NLS) from Simian Vacuolating Virus 40

| SEQ ID NO | Sequence |
|---|---|
| 68 | ATGCCAAAGAAAAAGAGGAAAGTCGAGGATCCGAAGAAGAAACGGAAGGTGGGTTCCGGTTCTATGCCTTCAGCTCAACGGTGCAT<br>CTGGGAGTGGAAGAGGGATATCTTCGTGACCAAGAATCCGACGCTCCGGGAGTCCGTGGATGAACTTAGCTTGCCAGGGACCAGGC<br>GCATCGTACAGGGATGGATCGACCAGCAAGCCCAATACCCGGAAGATGGGTCAGCAGACGAATATAGCTTTTATGCCGAAGAGTGC<br>TACCCAACCTCTCATGACCGGCGAGCGTTCTTCCATCGCTTCATTGCCGAGGCGAGACCGCATATCGGCTACAAGCTGGTTGCGCA<br>GTTGGCAGAAGCAGGGTTCTTGAGAACCATTTGGACGACCAACTTTGACGGACTGGTTAGCAGAGCGTGCACAGCGGCTAACGTCG<br>TGTGCGTGGAAGTGGGCATGGACACACCCCACAGGGCCTCACGACCGCAAGGGGATGACGAAGTCAGACTGGTGTCCCTCCACGGT<br>GACTTTAGGTATGACCTGCTGAAGAACACCGCCAATGAGCTGCGCGAGCAGGATTTGGCCCTTAGGGAGGAACTGCTGCACGAACT<br>CAAAGACTACGACCTGGTGGTCATCGGATATTCAGGGCGGGACGACAGCCTTATGCAAGTGCTCTCTGCTGCCTACAGCGACCGCG<br>CATCTTGTAGGCTCTACTGGTGCGGGTTTGGCGCGGAACCAGCACCGGAAGTGAGGCACCTTATTAAGAGCATCGACCCAGCCCGA<br>GAGAGCGCGTTCTACGTGGATACCGCCGGATTTGACGACGTAATGAGCAGGCTTGCACTCAGGCGACTGAGCGGTGAAAGCCTCGA<br>AAGGGCCCAGAAGCTCATAGAAAGCGTCACCCCGGTTGCTGGCAAAAAGATGGCCTTTAGTGTTCCACCATTGGCCCCTAGCGCCT<br>TGGTGAAGGGTAATGCCTACCGATTGACCTGTCCGGCAAACGTCTTGAAACTTGATATCGAACTTCCCGAGCACGGTTCCTGGCGC<br>GATTGGCTGTCCGAACGAATGACTCCAGAAAGGGGGCAGGCCGTTGTGTTCGAGAAGGGGAGCACTGGTTTTGGCCGACATGGCGGT<br>TACCGCTAAAGTTTTCGATGGATTTCTTAGGGTGAGCCCGACACGGGTGGAGATAAGTGACGAGAACATCATCGCTGACGGCCGGA<br>TCGCCAGTCTTTACCGACGAGCTCTCGTGAGCAGTGCCGCAAAAGCGCTCAGATCCAAACCGACCACAGGAGGAGGATATGGGAG<br>CCCGTGCACTATGATACAAGGCAACTCGACGATGTGACGTACCGCGTGCATCGAGCCGTCTCCCTGACGATAGTAGGGATAGAGGG<br>AGTGCCCCATGTGGTGCTGATGCCAGAGGTCGTCGCATCTACGTTGGCGGGCGACCTTGCGCCGGTTGACAGTCAAAAGACTCTCC<br>GCAATGCCATTTACGGGTTCCAACATAACGATAAGTTTGATGCCGACCTCAGCTATTGGACCCACCGCCTTGTTGAGAAGGAGCTG<br>GCTTCCAGCGGCGAGGGCGTTTTCGTATTGAGCAAAGTGCCACTTTATGCGGGCCTGGCACAAAAAGGTAAAGCTCCTCTCCCACA<br>CAGGTTTGCACGCCACGCTAAACAGCATGGAATTATTGTGCCCGACGCACCGCTTGTTTTCAGCGCCAAGGTTGGCTCTGGAGAGG<br>TACGAAACCCCAATCCGCTGCATGGGCTGGTGCAAAACCGGCCATGGGACCACTCTCTTACGGCGTCTGGTTTGTGTCCGAGTACA<br>GATGCTAGCGTGATCTGCCCCGCAGACGCTGCTCCGAGGTTTGAGAGATTCCTCCAATCTATGCAGGAGGTAGCAAGACCAAGCCA<br>GAGCGAGAGGGACTATTTGCATGATTTTCCCGGCTTCCCTGCGGCCTTTGGACTGCCACTCCGAATGCCCGTGAGAGGGGACGCAA<br>ACTGGATTACCATCGACGACGGAGTGAGCACCGATGCCCTGACAGGGGCTAAGCAACTGGCGCACCGAGTGTGCCAAGCACTCGAC<br>CACCTCCGCAGAGCAAGGCCCTCTGACACGGCGATCGTGTTCGTTCCCAGGAGATGGGAACCATATAAGGTAGTGGACACGCAGCA<br>CGAAAGATTCAATTTCCACGATTACATTAAGGCCTACGCGGCCAGGCACAGTCAGAGCACGCAGTTCGTCAGAGAAGAGACCATCC<br>AAAGCCAATACGTGTGTAGGGTCCGGTGGTGGTTGAGTTTGGCACTGTATGTTAAGGCTATGCGGACCCCCTGGCGGCTGGATGCG<br>CTTGATGAGAATACGGCTTTTGTTGGTATAGGGTACTCCCTGGACGCAGAGGCAGGGAGGGGCAACCATGTACTGCTCGGCTGCAG<br>CCACCTGTATTCTGCGAGGGGTGAGGGATTGCAGTTTAGGCTGGGCCGAATCGAGAATCCCGTGGTGCGAGGAAGGAACCCCTTCA<br>TGAGCGAGGACGACGCAAGGAGGACCGGAGACACCATCCGGCAGCTTTTCTACGATAGCAAAATGCATATTCCGACAAGGGTGGTG<br>ATACACAAGAGGACAAGGTTCACTGACGAGGAGCAGAGGGGGTTGGTACAAGGATTGGACGGTGTGAGGAATATCGAGCTGATAGA<br>GATCAACCAGGAAGAGACTTGCGATATCTCAGCAGCCAGATGAAGGACGGCAGATTTGAGATCGACAAGTTCCCCCTGTTCAGGG<br>GTACCACAATAGTTGAGTCAGATGACACTGCATTGCTGTGGGTGCATGGAGCCACACCCAGCGCCGTGAACAAGTACTGGAGGTAC<br>TACCAGGGGAAGCGCCGCATTCCGGCGCCATTGAGGATTCGAAGGTTCCTCGGGCAAAGCGACGTAGTGCAGATCGCGACCGAGAT<br>CTTGGGACTGTCTAAAATGAACTGGAATACGCTTGACTACTATTCAAGGATGCCTGCGACTCTGGATTCTGCAGGCAGTATTGCCA<br>AGTTCGGGTCATATCTTGATGGGTTTACGAGCGCACCCTATGATTACAGACTTCTGATCTAGTAA |
| 69 | ATGCCTAAAAAGAAAAGGAAGGTAGAGGACCCCAAGAAAAAGCGCAAAGTAGGGAGCGGTAGCATGAACTATACCGCTGCTAACAC<br>AGCGAACTTCCCGATATTTCTGAGCGAAATAAGCTTTCTCACAACCAATAACATTTGCTTGAACTGTTTCAAGCTTAACTACCAGG<br>TAACGAGGAAGATCGGTAACCGATTTTCATGGCAGTTCAGCAGGAATTCCCCGACGTTGTAGTGATATTCGAAGACAACTGCTTC<br>TGGGTCCTGGCAAAGGACGAGAAGTTCTTCCCCTCACCACACAGTGGAAGGAAGCACTTAGCGATATCCAGGAGGTTCTTAGAGA<br>GGACATCGGGGACCACTACTACAGCATCTATTGGCTTAAAGACTTTCAAATAAAGGCCCTGGTGACCGCCCAACTGGCGGTGAGGA<br>TACTCAAGATTTTCGGCAAATTTAGCTACCCAATCGTCTTTCCCAAGGATAGCCAGATATCAGAAAATCAAGTGCAGGTCAGGCGC<br>GAAGTTGACTTTTGGGCCGAGATCATCAATGACACCAACCCCGCAATCTGTCTGACCGTGGATAGTAGCATTGTGTGTACAGTGGCGA<br>CCTTGAACAGTTTTACGAAAACCACCCCTACAGGCAAGACGCCGCTAAGCTGCTGGTGGGACTGAAGGTGAAGACCATCGAAACCA<br>ATGGCACCGCGAAGATCATACGGATCGCCGGTACCATAGGCGAGCGCAGAGAAGACTTGCTGAAGAAGGCCACAGGCTCAATGTCA<br>CGACGGAAACTGGAGGAAGCCCATCTCGAACAACCCGTCGTCGCAGTCCAGTTCGGAAAGAACCCCCAGGAGTACATATACCCGCT<br>TGCCGCCCTTAAACCTAGCGTGACCGACGAAGATGAGAGCCTCTTCCAGGTCAACCACGGAGACTTGTTGAAGGAGACCAAGATCC<br>TGTATGCGGAGAGGCAGGAGCTTCTGAAGCTGTACAAGCAGGAGGCCCAGAAAACCTGAACAACTTTGGGTTCCAGTTGAGGGAG<br>AGGTCCATCAATTCTCAGGAATATCCTGAGGTGTTTTGGACTCCAGCATCAGCCTGGAGCAAACCCCAATCTTGTTTGGCAAGGG<br>GGAGCGAGGTGAAAAAAGAGAGATTTTGAAGGGCCTGAGCAAAGGCGGAGTGTACAAAAGGCACAGGGAATACGTGGACACAGCTC<br>GCAAAATTCGCCTGGCCATACTTAAGCCCGCTAACCTCCGCGTGGGCGACTTTCGGGAGCAACTTGAGAAGCGATTGAAGCTTTAT<br>AAGTTTGAGACAATTCTGCCACCGGAGAACCAAATTAACTTCAGTGTTCGAAGGCGAAGGTTCCGAAAAGAGGGCCCGATTGGAAGA<br>AGCGGTCGACAGACTCATAAGGGGGGAGATCCCCGTAGACATTGCACTGGTGTTCCTCCCGCAGAGCGATAGGAATGCAGACAACA<br>CCGAGGAGGGAAGCCTTTACAGTTGGATCAAGAGAAAATTCCTCGATAGGGGCGTGATTACACAGATGATTTATGAGAAAACGCTT<br>AACAATAAGTCACAGTACAACAACATCCTGAACCAGGTGGTGCCGGGGATTCTTGCGAAGCTGGGAAACCTGCCATACGTTCTTGC<br>AGAGCCGCTTGAGATAGCCGACTACTTCATAGGCCTGGATGTGGGGCGGATGCCAAAGAAGAATCTTCCGGGGAGCCTCAACGTGT<br>GCGCGTCTGTCAGGCTCTATGGCAAGCAAGGCGAGTTCGTGCGTGCCGCGTCGAGGACAGCTTGACCGAGGGCGAAGAGATTCCC<br>CAGCGGATCCTGGAAAATTGCCTGCCCCAAGCAGAACTTAAAAACCAAACTGTCCTTATCTACAGAGATGGTAAATTCCAGGGAAA<br>GGAGGTGGATAACCTTTTGGCTAGGGCTCGCGCAATCAATGCCAAGTTCATACTGGTTGAGTGCTACAAGACCGGTATCCCCCGAC<br>TGTATAACTTCGAGCAAAAACAGATCAACGCACCCTCCAAGGGGCTGGCACTCGCGTTGACAACCAGAGGTGTTGATCTTGATTACG<br>AGCCAAGTGAGCGAGAAGATAGGCGTTCCTCGGCCACTTAGACTCAAAGTGAATGAGCTGGGTGAACAGGTGAACCTGAAGCAGCT<br>GGTCGATACCACTCTTAAACTCACGCTGCTCCACTATGGGTCTCTGAAAGACCCCACGGCTGCCTATTCCCCTGTACGGTGCCGACA<br>TCATAGCCTATCGGCGGCTGCAAGGAATCTACCCATCCCTTCTCGAGGATGATTGTCAGTTCTGGCTGTAGTAA |
| 70 | ATGCCGAAGAAAAAGCGCAAGGTAGAAGACCCTAAAAAGAAGCGAAAGTTGGCAGCGGGTCAATGAACACGCCTTTGACGCATTA<br>CGTGCTCACCGAGTGGGAATCCGATACAAATACTAATGTATTGCACATCCACCTGTACACCCTCCCCGTTAGGAACGTGTTCGAGC<br>AGCACAAGGAGAACGGTAACGCATGTTTCGATCTTCGCAAGCTGAATAGGAGTCTGATCATCGACTTCTACGACCAATATATCGTG<br>AGCTGGCAGCCTATAGAAAACTGGGCGCAGTACACCTTCACCCAGCACGAATACCGCAGTATAAACCCAACAATACTGGCCGAGAG<br>GGCCATCCTCGAACGACTCCTCTTGCGGACAATCGAAAGCGTCCAGCCCAAGAAGGAGATCGCAGCTGGTTCCCGCAAGTTTACCT<br>GGCTGAAGGCAGAGAAGGTCGTGGAGAACATTAGCATCCACAGGGTAATCCAGTGCGACGTAACCGTGGACTACGCCGGCAAGATC<br>TCTGTGGGCTTTGACCTCAATCACAGCTATAGGACAAATGAGAGCGTGTACGACCTCATGAAGTCTAACGCCATCTTTAAGGGAGA<br>CCGCGTGATAGACATTTACAATAACCTGCACTACGAGTTTGTAGAGATTTCCAACTTCCACAATAAATGACTCCATCCCCGAGCTCA<br>ACCAAAGTGTCGTCAACTACTTTACGAAGGAGCGAAAGCAAGCATGGAAAGTGGATAAGCTGGAACAGAGCATGCCAGTCGTGTAC |

TABLE 17-continued

Argonaute nucleotide sequences containing 2X Nuclear localization sequence (NLS) from Simian Vacuolating Virus 40

| SEQ ID NO | Sequence |
|---|---|
| | CTCAAGGCATTCAACGGCAGTAGGATTGCATACGCGCCTGCGATGCTCCAAAAAGAGCTGACCTTTGAGAGTCTCCCGACCAACGT AGTACGGCAGACGTCAGAAATATTCAAGCAAAATGCCAATCAGAAAATCAGGACCTTGCTGGATGAAATCCAAAAGATTCTTGCCC GCACCGACAAGATCAAATTCAACAAGCAGAAGCTGTTGGTTCAGCAGGCCGGCTACGAGATACTTGAACTGTCCAACCCAAACCTC CAGTTTGGGAAGAACGTTACTCAGACGCAACTGAAGTATGGACTGGATAAAGGCGGAGTTGTGGCCTCCAAGCCGCTCAGCATCAA TCTTCTGGTCTACCCGGAACTTATAGACACCAAGCTCGATGTGATCAACGATTTCAATGACAAACTGAACGCTTTGTCCCACAAT GGGGCGTGCCCCTGAGTATCCTGAAGAAGTCTGGAGCGTACCGCAACAGACCCATTGATTTCACTAACCCCCACCAGCTCGCGATT CTGTTGAAGGAACTGACCAAGAACCTTTTCCAGGAACTCACGCTTGTGATAATACCGGAAAAGATCAGCGGCATGTGGTACGATCT GGTTAAAAAGGAATTTGGCGGCAATAGCAGTGTTCCGACGCAATTTATCACCATCGAGACACTTCAGAAGGCAAACGACTATATTC TGGGGAACCTGCTCCTTGGCCTCTATAGCAAGTCCGGCATCCAACCATGGATTCTTAATAGCCCCCTTAGCTCCGACTGCTTCATC GGTCTGGACGTATCACATGAGGCGGGTCGCCACAGCACCGGGATAGTCCAAGTCGTAGGAAAGGACGGGCGCGTTGTCATCCAA GGCGAATACGAGCAATGAAGCCGGCGAGAAGATCCGCCACGAGACCATGTGCCAAATAGTGTATAGCGCCATCGACCAGTACCAGC AACACTACAACGAGAGGCCTAAGCACGTGACCTTCCACCGCGACGGTTTTTGCAGGGAGGACCTGCTGTCACTCGACGAGGTGATG AACTCCCTGGATGTCCAGTACGACATGGTGGAGATCATCAAAAAAACCAATCGGCGAATGGCACTGACCGTCGGCAAACAAGGATG GGAAACCAAGCCAGGACTGTGCTACCTGAAGGACGAGAGCGCCTATCTGATCGCCACCAATCCGCACCCGAGGGTGGGCACCGCGC AACCCATCAAGATTATCAAGAAGAAGGGGAGCCTCCCTATCGAGGCCATTATACAGGACATCTACCACCTGAGCTTCATGCATATC GGCTCACTGCTTAAGTGCCGACTCCCCATCACAACTTATTACGCCGATCTGTCTAGCACCTTCTTTAACCGCCAATGGCTTCCGAT CGATAGTGGCGAGGCCCTTCACTTCGTGTAGTAA |
| 71 | ATGCCGAAAAAGAAGCGGAAAGTTGAGGACCCCAAGAAAAAGCGCAAGGTGGGCAGCGGCTCCATGCTTATCTGGCAATTCAAGAG AATGCTCTACTGCCAGGCCAACAACATCAAAGAGGAAAAATTCAAAGACCTGGAGAGCGAGCGAAATCAAAACACTATCCAGAGCT ATTTTGACCTGAAGGGCGGCTATCCGGAAAGATATAGCCAGGAGGAATACTCCGCTTATTTCGAGCATTGCTTCCCGAAGTCTATC AACCGGAAGTATTTCATGCAGAAAATAGTAGAGGGCCGAAATCCGAGCATAGGTCACAAGTGTTTGGGTGCCCTGTTCGACTGCAA AAAGGTAAACCACATCTGGACAACCAACTTCAACGAGCTCATCGAGAATGGGATTAAAAGCGTCAACAATGCCAGCAGCTTCGAGG TCATTAGTATCGACAATCAGAGGCAGCTGGCCAACCTCAACAACTACCCAAGGGTGGTAAAACTTCACGGCGACTACAGGTACGAC AAGCTCCAAAATACCGTTGACGAACTGCAGACGCTGGAGAAGGACCTCCATAAGTACTTCGCCGATGTGCAAAGCAAGACCGGCTT GATTGTGATAGGCTACGGCGGAAACGACCAGAGCATCATGTCCGCCTTTGAAAAGACTTTGGAGGCCGACAACCCGTTCCCGTTTG GGCTTTACTGGTGCGTGAGGACGGGCCAGAAAACCAACAAGAAGGTAATCGAATTCATAGAGAAGGTTCACCAGAAGAACAAGGAA AAGCTTGCTGCGTTCATCGAAATCGACTCTTTTGACGATTTTCTTTATGAGCTGTATAAGACGAACAACCTTGCCAACGATCACAT TGAAAATATCGCCAAAAGCCGCTTCGAAAAAAGGAAGGCTTTTACAGCCCCCCAGATCGGCACCTCCTTTACGCCTATAAAGCTTA ACGCCATAAAGGCCAAGACTTACCCGAAAAGCATCTATTCCTTTAAAACTGACCTCAAGGGGGGCAAGGATGACTGGGATAAACTC AGGGGAAATCATTAAGGACCAACCGGTGAGCGCGGCTCTGACCAATGAAAACACGGTCGCCTTCGCAAGTGTCAACGACATCAAGA ACTCTTCTCACACACACTGAAGTCAGAGATCACCACCGTGGACATAGATGACAAGTTGATCTATCGGCAGGAGTCTTTCTACCTGG GCATGCTTTACGATCTGATAGAGCACAACCTCCTGAAGAAGTTCAAGTTGGAGAAAGTGCCCAACAATAGGCTCCGCAAGTATTAT AGCAAAAACTACAAGCTGAATACCGAGGAGCTTCAGAAGTCCAAGATCAAGACCAGCCTGTCCGTCTACGAAGCGTTCGAGATTCA AATAGAATTCCACAATAAAGAGCTGTTCCTCATTATCCTTCCGTCCATCCACATAGACGACAAAGCCGGGCTGAGCCGATTTGAGA AACAGGAGATAGCCAATAAGATCATAAGCAAAAGGTGGAACCGCATGGTTAACAACCAGCTTAGGTTCTGGCTGGGGCTCCTTAAG AACGATAACACTAACATAGAGTTCAGCATCGACAGTTTCAAGATTGATTTGGAAGAAAAGTTCTCCGGCGTCGGGAGCTTTACATC CTCTTACTACATCTTTAAGGGCGCGTTTATTTCCAACGAACCCAAGCTTAGCTTCCATATCTCCGACAGCAATTACAAAACAGTGC ACCCCCTGAAAGGCCTCAAGAACTTCGGTCCACTGGATTACTCATTTGAAAGCAAACAGACCAATCAGCAGGCTATTAAACTTGGT ATAATCACTCCGATCAGCGGCATGCAACGGATACTCAAACACCTGAACACTTAATAACGAGATCCGCGACGCTACGGAAAAGGA GTACCTGACCGATTATTACCCCTTTAGCAACATCTACAAGAGATACCTTGACATCCCGCAGAATAAGGATAGTAAATTCTTGGAAC TCGTGAATGAAGCCGAAGTGAACAAACTGAACCACCTCGAGTTTTATGACTTCCTCAAACGCAAAATTGATTACTTCTATACAATT AGGGGCGAGTTCGACGTGCTTGTGTTGTATTTTCCCAAAGGCTGGACTAAGTTCCGCGAGCTGAAAAATGACAGTGTCTACTTTGA TCTGCACGACTCCATCAAGCTGTACTGTGCTAAGAAGAATATCAAGATCCAATTCGTGGAAGATAAGTATAGACTACCTCGACC CGGCCAAGGTTAAATGGTGGTTGAGCCTCGGCTTGTATGTCAAAGCGAACGGGCTGCCCTGGCGGAACGTGGTCGTAAACGAAAGC ACCGCGTTTGTCGGGCTCGACTTCGCGGTCCAGCGAATAAACAACAGTAACAAGTACGTGCTGGGTAGCTCACAGATCTTCGACAG CTCCGGACAAGGACTCAGGTTTCTGTTGCAGCCCATCGAACACCCTGTGTTTATCGGTAAAAACCCCTTCATGAGCAAGGAAGATG CGCGACGGATGATTCTTAAATTGAAGGAAGCGTATTTTAGGATTGACGGTAACTCCAAGCTGCAAAAAACTGGTGGTGCACAAAGTA CTGCATTACACAAATGATGAGATGACCGGCATTTCCGAGGCGCTGGAAGGTATTGAGAACATTGAGCTTCTGCAAATACAGAAGTA TAGTAAGTGGAGGGCAATTAGAGGGGACATCGATCGGTATCGGGAAAGGTGAAGACCGACCCGCACAATTTCCCGATCCAACGGG GGACAGTGATCCAGCTCGACGACTTCTCTTTCCTTCGTGGACACATGGAAGTGTACAGGAAGACGACGTGGCTGGTAGGCACATG AATTACTACCAGGGTAAGCGCGGGATTCCCGCCACCACTTCTCATACGGAGGTTTCGCGGCCACCGATCCGATTCGAATTGAAATGACGTCG AGACATCCTGTCACTCACCAAGATGAACATGGAACGGAGGCGAACTTTACAAGACTCTGCCGGTGACCCTGGATTTCTCTAAACGGC TTTCTAAGTATGCGAAGCAGGCAGAGACCCTCCAGGCAATACCCTACGACTTTCGGTTCTTCATGTAGTAA |
| 72 | ATGCCCAAGAAAAAGCGAAAGGTAGAGGACCCCAAAAAGAAACGCAAAGTGGGCTCCGGAAGCCTGAAGCTGAACCACTTCCCCCT TAATCCCGACCTCCCCCTGTACATCCAGAATATGCCCCACCGGAAACCCGCGAGCGTTGCTCGGATTCGTTAGGGGCCAAGGTTTCT GGGCGCAACAGGTCGGAGAACAGGTACAAGTGTACCACGGTAGACCGCAGCCCACGTTCAGGGGAGTTCAGGTGATCAGCCATACC AGGTTGGACCCCGACCATCCGGCTTTTGACCAAGGCGTTTTGAGCCTCATCCGAAGCACTGGTGAGGGCGGGATACGTGCTGAC CTACAGGGAGAGGATGGCTATTCATCCCAGACTGGAGAGGGTTGTGCTGAGACCCCGGACCGGCACCCAGCAGAGTTGACCGTCC ATGCACATCTGCGATGGAGATTGGGAGCTTGAAAGGCACAGCGGACACGCTGGCTGGTTCTTCGACCCGGCAGGCGGACATCTGAGC GCCCTTCCATGGCCCGCAGAAGCAGTACAAATGTGGTCCGCGCTCTTCCGGCCACCTGCCAGAAGCTGCACGCCCTTTGTCTGGA CCGAGGCCAACAGATGGCCCTTTTGCGGCAAGAGGACGGCTGGCACTTCGCCAATCCCGGTGCTGCCACTCAAGGAAGGTGGCACC TGTCCTTTAGCCCCCAGGCCCTTCACGAGCTGGGACTGGCACAGGCTGCGCACCATGCGGCTGCATTTAGGTGGGACGAGGTACAG CGACTCGTGCAACTGACTGACCTGACTGTGAAGCCCTTCGTGACCTCTGTGGAGCCCCTTGAGGTAGCTGCCCCCATCATTGCCGGGAA AAGGCTGAGGTTTGGACGGGGTCTTGGCCGCGATGTCACGGAGGTGCACAAGCGAGGTATCCTGGAACCACCCCCACTGCCCGTGC GACTGGCTGTCGTGTCTCCCCATCTTCCTGATGAGCACGCGAACGCCCAGTTGAGGCGGGAGTTGCTTGCTCACCTCCTCCCGCGA CACCAAGTACTGAGATCAGCGGAGAGCCGGCAAGGCCTCCACGAGCACCTGAGGAGGCAAGATCAGGACGATACCCTGTATACCTT TTGGTCAGGCGGCGAGTACGAGGAGCTGGGCTTGCCCCCCTTCGATCTCGCACGAGGCCTGCACACCTACGACCCAGCTAGCGGCC AGCTGCAACAACCGGCTGCCCTGGCCAGCACCCGCGGCAGGCCACGCAAGCGGGTAGGCAGCGCTGATAGCCCTGGTGGTGTTGCCC GACGACCTGACGCGGTCTGTCGGGACACCCGTTTCAGCAGTCCAGCAGTTGGGCCTTAGGTGTCTGTTTAGTGTGAGCAGGAC CCTGCTGCACCGACCACGCACAGAGTATATGGCATGGGTAAACATGGCCGTCAAGTTGGCTAGGACTGCAGGGGCCGTGCCTTGGG ACCTGGCAGACCTGCCCGGTGTCACCGAGCAGACGTTTTCGTAGGCGTTGATCTGGGGCATGACCACACCCACCAACAGTCCCTC CCGGCCTTCACCCTGCACGACCATAGGGGACGCCCTCTTCAAAGCTGGACGCCTCCCCGACGCACCAATAATGAGAGGCTGTCATT |

TABLE 17-continued

Argonaute nucleotide sequences containing 2X Nuclear localization sequence (NLS) from Simian Vacuolating Virus 40

| SEQ ID NO | Sequence |
| --- | --- |
|  | GGCCGAGCTTAAGAAGGGGTTGCATAGGCTTCTTGCACGCAGGAGCGTGGACCAAGTGATCGTGCATCGAGACGGCCGATTCCTTG<br>CTGGCGAGGTGGACGACTTCACTCTGGCGTTGCATGATCTCGGCATCCCGCAGTTTAGCTTGTTGGCAATCAAAAAAAGCAACCAC<br>AGCGTGGCGGTGCAAGCAGAGGAAGGATCCGTGCTTAGCCTGGACGAACGACGATGCCTTCTTGTTACTAATACCCAAGCCGCGCT<br>TCCGCGGCCCACGGAGTTGGAACTGGTCCATAGCGACAGGCTTAGTTTGGCGACCCTGACCGAACAAGTATTCTGGCTGACCCGCG<br>TCTTCATGAACAACGCGCAGCATGCGGGCAGCGATCCAGCCACCATCGAATGGGCCAACGGCATAGCCAGGACTGGACAGCGAGTG<br>CCCCTGGCCGGGTGGCGGCTGTAGTAA |
| 73 | ATGCCAAAGAAGAAGCGAAAAGTGGAGGACCCTAAGAAAAAAGAAAGGTGGGCTCAGGGAGCATGGAGGCGTACATAACGGAGAT<br>GGTGTCCAGGGAGAGGGCCAACGAGCTGGAGGTTTACGTGTACGTGTTTCCACGGAAGCAATCCGACAACAACTACGAGGGTGTGT<br>ATCACATAATGAGGGCGTGGCAACGGGCTAATGACCTGCCTCTGGCGTATAATCAACATACGATCATGGCATTTTCCCCCGTGAGG<br>CATATGTGTGGCTACACGCCGATGGAGACGCAGAAACGCCATATTAACATTGACTCCCCATTCGAGAGAGCCCTGCTGGAGCGACT<br>GATAAAGAACAGCCTGATTTTTACAGCCGAGCGCCATTTGCATGCCAAGCGGGTAGGCCATGCGCTTCGGCTGAACCAGGTGCAGC<br>AAATCCGGCAGGTGATCATCTATGAGGCCATCGAGCTCTATGTAAATATCATTGAGAATAGAATAAGCATCGGCTTTCACCTCACC<br>CACCAGTTCGAGTACGTATACACTCTCCAGAGCATGATAGAACAGGGAAAAACAATCAGACCTGGAATGCGCGTCGTGCATTCTAA<br>CGGAAGGCAGCATTATACCTACACCGTGGAGAACGTAGCAACATGGGGTGACCGACAGATGCCCGCTGCTGCAGACCAGCATTT<br>ACCAATACTACGTCGAAAAGGCGCGCAGCACATTTTGCGCACCTTCACCCGATCCACCAGGGTGATCCACGTAAGAACGAAAGAG<br>CAGAGGTTGAGCTACGCGGCGACACTCCTGAAACCGCTGTGTACTTTTGAGACCATGCAACCCAGGACGTGCTCAATGTCAGCAA<br>GTGCATCAAACTTAGCGCGAGCAAACGAATGAAATGTACTTACAGGTGGATTCAGCAACTCCGGGCACAGTACCGACACCTGACCT<br>TTGCGCCGAACCCCTTCACGATCGCCCAGAATGGCTATAAACTTGATCAGCTCAGCACCCCCAAGGTGCACTTCCACAGAGACTAC<br>GCCACCGTCGTGAGCGGAATGAAGACCGGCAAGCTTTACAAAGGCGGTAATATCAAGATCAGCGTGCTCTTCGACGAGGACTTTTA<br>CTTGAAACACCACATCACCAAGAAGGACATATATCAATTCATTGCAGTCCTGCAGAAAATCGCCATCGCACAAGGCGTGAACATGA<br>CCATAAGCACGAGCACCAAGTCCATTACGGGCAAGTTCACGGACGACTTTTTCCACCACTTCACCGAGGAGGTCGAAGCACTGCAG<br>CCCATCTTCGCGCAAACCACAGTTCTGGCATTCATTACCAGTACCCACCTGAGCAACAAGAAAACCAGGAGTTACCAGCTGCTGAA<br>ACAGTACTTCGGCGGCAAGTGGGACATTGCCTCTCAAGTCATCACGGAGAAGACGATTGAGGCGTTCCAAAAAATCTTGCACAAGC<br>ACGGCCTGAAGAATTTCTACCCCAATGACGAACAGCACTGTCTCCGCGTGATCGATGTCCTCAAGAATGAGAGCTTCTACTACACG<br>GTCATGAACATCCTCTTGGGAGTATATGTGAAAAGCGGCATCCAGCCCTGGATCCTTGCTAATACAACCCACTCAGACTGCTTCAT<br>CGGCATCGACGTTAGCCACGAGAACGGAAACTCTGCGGCTGGGATGATGAATGTTATCGGCAGCCAGGGCCACCTTATCCAACAGG<br>CGCCCCTGAACGGCATATTGGCGGGAGAAAAGATTGACGACACCCTGCTCGCAAACTTGCTTAAACAAATGATTAAGGCATACCAC<br>ACCCAGTTCCAGCGCTTTCCCAAGCATATAACAATCCACAGGGACGGCTTTTGGAGAGAACACACTGCACTGGTCGAGAAGATCAT<br>GAGCCACTATGAGATTACCTACGACATCGTCGAGATCATCAAAAAGCCTAATAGGAGGATGGCTTTCTTCAACAGCGTGGACAACA<br>CCTTTAGCACCAGGCAGGGGACAGTGTACCAACGGGGCAACGAAGCCTTTCTGTGCGCCACTAACCCTCAGCAGAAAGTGGGCATG<br>GCACAACCAATCAAAATACATCAGGTGACCAAGACCCTGCCCTTCTCACACATCATAGAAGATGTCTACAACCTCAGCTTCCTTCA<br>TATTCACGCTATGAATAAGATGCGACTGCCGGCCACCATACATTATGCCGACCTGTCTGCCACCGCTTACCAGAGGGGCCAAGTGA<br>TGCCCAGGAGCGGTAACCAGACAAATCTGCCTTTCGTGTAGTAA |
| 74 | ATGCCTAAAAAGAAACGCAAGGTAGAGGATCCCAAGAAGAAAAGGAAGGTGGGGAGCGGGAGCGTTCACGCATTGCTCGCTCTGCT<br>CGCGAACCGAGCCGGTGGAAGGACCGCCAGAATGGGAGACAGCTTGCTCACGTGGACCCTCCTGAGTCTCTGCTGCTTGAAGGGA<br>CCCTGAGCTGGCGCGGCAACACCTACACATACCGGCTTCGCCCACTGGCGAGAAGGGTGCTCAACCCTAGGAATCCCAGTGAGAGA<br>GACGCCTTGTCCGCGTTGGCGCGACGACTCCTCCGAGAAGTGCTTGAGCAATTCAGGCGCGAGGGGTTTGGGTTGAAGGTTGGGC<br>CTTTTACAGGAAGGAGCACGCACGGGGTCCCGGGTGGCGCGTGCTGAAAGGTGCGGCGCTGGATCTGTGGGTTTCAGCCGAGGGGG<br>CCATGGTATTGGAGGTGGATCCGACTTATCGAATCCTGTGTGACATGACACTCGAGGCGTGGCTTGCACAGGGACATCCACCCCCG<br>AAACGCGTCAAGAACGCGTACAACGACAGGACATGGGAACTCCTGGGTCTGGGTGAGGAGGACCCGCAAGGCATTCTTTTGCCAGG<br>CGGGCTGAACCTCGTCGAGTACCACGCTAGTAAGGGCAGAATCAGAGACGGCGGGTGGGGTCGGGTTGCGTGGGTGGCAAATCCTA<br>AAGACGCCAAAGAGAAGATCCCGCATTTGACGAGCTTGTTGATCCCCGTCTTGACCCTGGAGAACCTGCATGAAGAGGGGGGCTCT<br>AACTTGGCCCTCTCCATCCCGTGGAATCAAAGGCAAGAGGAAACCCTTAAAGTGGCCCTGTCCGTGGCTCGCCGACTCGGCGTCGA<br>ACACCCCAAGCCCGTCGAGGCCAAAGCCTGGAGGATGAGGATGCCAGAGCTTCGCGCACGACGCAGGGTGGGTAAGCCAGCGGACG<br>CCCTTAGAGTGGGGCTGTACCGGGCTCAAGAGACTACCCTCGCACTGCTTCGGCTCGATGGCGGCAGAGGATGGCCTGACTTTCTG<br>CTTAAAGCATTGGAGAACGCTTTTAGGGCCAGCCAGGCTAGGCTTCATGTTAGGGAAATCCACGCGGATCCTAGCCAGCCCCTTGC<br>ATTTAGAGAAGCCTTGGAAGAAGCGAAAGAAGCAGGTGTGCAGGCTGTCCTCGTACTCACCCCCCCACTGAGTTGGGAGGAGCGAC<br>ACCGCTTGAAAGCACTGTTCCTCAAAGAAGGACTCCCAAGTCAACTTCTGAACGTCCCCATACAGAGGGAGGAAAGGCATCGGTTG<br>GAAAACGCCCTGCTCGGGCTCCTGGCGAAAGCGGGTCTCCAAGTAGTCGCCCTTGAGGGCGCATACCCTGCTGATTTGACAGTTGG<br>ATTTGATGCCGGAGGCCGCAAGTCCTTTAGGTTCGGAGGTGCCGGATTGCTGTCGGCTCCGACGGAGGTCACTTGCTGTGGAGTC<br>TGCCGGAAGCCCAAGCGGGCGAACGGATACCAGGCGAAGTAGTTTGGGACCTGTTGGAGGAGGCGTTGCTGGTGTTTAAGAGAAAA<br>AGAGGGCGGTTGCCCAGCCGGGTGCTTCTGCTGAGGGATGGCAGGCTTCCCAAGGACGAGTTCACCCTGGCACTTGCAAAGCTGAG<br>GCAGCTCGGCATTGGCTTCGACCTCGTGTCCGTAAGGAAGAGTGGAGGCGGAAGGATTTATCCGACCCGGGGAAGATTGCTTGACG<br>GCCTTCTGGTGCCCGTTGAAGAGAGGACTTTTTTGCTCCTGACGGTGCATAGGGAGTTCAGAGGCACCCCACGGCCCCTCAAATTG<br>GTACACGAAGAAGGTGAGACACCTCTGGAGGCTCTCGCAGAGCAGATCTACCACCTGACGAGGCTGTATCCTGCATCAGGTTTCGC<br>ATTTCCCAGACTGCCCGCACCCCTGCACTTGGCAGATAGGCTCGTGAAAGAGGTGGGCCGATTGGGCGTGAGGCATCTCAAGGAAG<br>TAGACAGGGAAAAGCTGTTCTTTGTATAGTAA |
| 75 | ATGCCTAAGAAGAAGCGAAAAGTGGAAGACCCAAAAAGAAAAGGAAGGTGGGTAGCGGCAGCATGAACGCCGTGACCGTGGGCAG<br>CACCCCAAGCGCCCAGGTACTCGTCGGTGTTCAGCCATACGACGAAACCACCCTGGAGAGCCTGAGAAGTAAACACCGCGGAGACT<br>ATCTCTTTAAAAGGGGGGAGAGAACGGCGATAGCATACTTGCTGTGGCCCTGAAACCGAGTCTGCCGGTCATCGGAGCAACCGAG<br>GAGGATGTAATTCTTGCCGAGAGCCCATGGTTGTTGGCTCCACTTGCCTTGGAGACTTTGCTGCAATGCTTCGTGAGGCTTCAAAG<br>GCCCATCCTGAAAGCTAGGCATCCCCTGAGAGTGCTCTCACAAAAACCGGCAAATCTTTTCCCAGCCGATGCGGGGGTCCCCCAGT<br>GGCTGCAGAGGAGCTGGTGCTGGAATTCGACACGCGCACTGTTAGGGACAGGTCAGACGCTGCCTCTGTCGTGCTGGCATGTGGC<br>GTGAGGACTCGGAATTTGATTGATGCCGACTGCGCGACACTGATAGCAGCCGGTGTCCCCTTGTGAATCGATACGTGGTGACGAG<br>GCACCCTGCGGATGATCCCCGAGTGCAGGGCTATTTGAGGCTCGCCGGGAGGGTGACCAGGATAGATGGCCCAACCTGTACTTGG<br>AGGATCATGGCGATGGAGCAGCTGTGATCAAGGCCTCCATGGCCTATCTGGAGCCCAGGAGGGAGAAGTGTGATTTGGTGTGCCAC<br>CATTTGCTGGGGAGAAATGCGGATAGAGTACTGGCGAAGCGGATAACGCAGCCGCAAAGCACTTGAGCGGTCCCGAACGATTGGC<br>CGTAGTGAAGAAGACTTTCGACTACCTTAGGAGCCAGAACATCGAGCTTGCGCCTGGAGTGCCCCTCACTCTGGGTAACGTTGTGG<br>GGAATGACAAGGGTTCTTGGATCTTCCGGACGGAAACTCTGCCCAAGCCCCACCTGGTGTTCGACCCGAGCGGGACCCGGATCGAT<br>AGGTGGAATGAGAGGGGATTGGACGCTCACGGGCCCTATGATCAAAGGACTTCACCCCTAAACAACTGAGGATTGCCGTCATATG<br>TCAACTGCCCTACGAAGGCCAGGTCGATGCGTTCCTGGCAAAATTTCTCGACGGCCTTCCAGACGTGAAGACCGGCTACGGGGACC |

TABLE 17-continued

Argonaute nucleotide sequences containing 2X Nuclear localization sequence (NLS) from Simian Vacuolating Virus 40

| SEQ ID NO | Sequence |
|---|---|
|  | GGGCCAGGGCGCCTTATGCCAAGGGGTTCATCAGGAGGTACGGTCTGGAGAAGCCCAAGGTGAGCACCTTCGCAACAAAAGGCGCT<br>ACTGCTAAGGACTATGCCGCTGCATGTAGGGCGGCTGTGGAGGACGCAACCGCAAGCGGCTTCGAGTGGAATCTGGCTATCGTGCA<br>GATCGACAAGGATTTCAAGGAGCTGAGTGACGTGGAGAATCCCTACTTCACCACCAAGGCCCTGCTGCTGAAGCATCGGGTGCCCG<br>TCCAAGAGGTGACGCTGGAGACGATGAGGTTGGCAGACGAACAGCTGGTGTACGTGTTGAACAACATGAGCGTAGCCACCTACGCC<br>AAAGTGGGCGGTACTCCCTGGCTCTTGAAAGCGCAACCAACCGTGGCCCATGAGTTGGTAGTTGGAATCGGAAGCCAGACTTTTAG<br>TGCCTCAAGGCTGGGTGAGAAAGAGAGGGTTGTAGGCCTTACCACCGTGTTCTCCTCCGACGGGAAATACCTGCTGGACGACCGGA<br>CTAGCGCCGTTGATTACGACAACTATAGCGAAGAGCTGTTTAAGAGCTTGTCCCGGTCAATAGAATCAGTAAGGATCGCCGATAAC<br>TGGCGAAGTACGGACAGTGTCAGGCTGATTTTCCATGTTTTCAAGCAGATGGCGGACGAGGAAGCCGACGCGGTTGACAAGTTGGT<br>GCAAAAGCTGGGTTTGGCACAGGTTAAGTTCGCGTTTCTGCACATCGTGGATGACCACCCATTCGCCCTGTTTGACGAGAAGAACA<br>TAGGTACAAAGACATGGGGTGGGATATTCAAGGGCGTCTTGGCACCGGAAAGGGGCCTCGCGGTAAACCTCTCTGGGGCCGAAACC<br>CTGTTGTGCTTCACAGGCGGCAGGGAACTGAAACAGGCGAAGGATGGCCTGCCCGTGCCTAGTCTGCTGCGACTGCACCACAGGAG<br>TACGTTCAGGGACATGACCTACCTGACGGGGCAAGCCTTCAACTTCAGCTGTCACACCTGGCGCATGTTCACACCCGCTCCTGTTC<br>CCATCACAATCATTACAGCGAGCTGATGGCGCGACTCCTTACGGGCCTCAGGCACGTCCCGGATTGGGATCCAGACACAATGCTG<br>ACCCCCATCAGTCGAACCCGGTGGTTCCTGTAGTAA |
| 76 | ATGCCCAAGAAGAAAAGGAAGGTAGAGGATCCAAAGAAAAAGCGGAAGGTTGGAAGTGGAAGCCTCCCCATCGTCCTGAACGCCTT<br>CCCACTTAAAGTACCCGAACTGGAGCTGGAAGTTAGGCAAATACCGTACGATAAAGAGACGCTTGACGGCCTCAGGGCTGCGCACA<br>AGGCCACCCACGCTTTCCGCAGGCAGGGCGACAACATACTGATTTTTTCCGGTGATGGCACATTTCCCGCGTCTGGGACGCCTCAA<br>ACTATTGCACTGAAGGACAATTTCGGCGTGTTCTACAGCCTCGTGAAGGATGGTCTTATCCGCCACCTTGCGGGGCTCGGGAGGAA<br>TCCCAGCGGGTTCAACCCCATAGAGTTGGTGTCCGCAAAACCCGAAGACAACCTGCTGGTCCCCATACTCGGCGATGCGTATCCTT<br>TTAAGGTGTGCGCGAAATACAGCATTGACACCAGAACCGTGCTGGGCACCCATGTCTGGTGATCGATTGCACGACCAGGAGGGTG<br>TTGAAGGAAAATGGCTTGTTCTTTTTTGAACGCTGGGTTCGACCTCGCGGGCAGGTACGTGGTGACGGAGCAAGATGACGGGTACAG<br>GAAATTGCTCGGCAGCGTGAGCGGCTGTAAGGGTGAAACGCTGACTAGGCCCGATGGCCAAGTGGTGCAGGCCGAGGCTA<br>AAAACGTGTACCTGGAGGCATCCCGCACAAATTTCGACGACTATATTCTGCACACCCACAGGGCTCAGAAGGACGCGATCGTTGAA<br>CGAATCAGACAGTCCGTTTCCGTGTTTAATGGGGGCGAAAATAAGAAAGCCCGAATCGACACGCTGAAGAAGTATATCCAGTCCAA<br>AACCATTCCCTTGATCGACGGCACCAGGATTGAGATCCAAGATTCCCCTAACATACAGAAAGACTGCGGCCAGATGCAAAAACCGG<br>TATTCGTCTTTAACGACAACGGCGAGGCGGACTGGGCGGAGAAGGGGCTGACCCAATCTGGGCCGTACACCAAGAGGACCTTCGAC<br>AGGAATGACCCCTCCATTTGCGTGATCTGCGCCCAACATGACAAGGGACGCGTTGAGCAGTTCGTCAGGAAGTTGCTTAAGGGCAT<br>TCCAAACTCCAAATACTTCAGCAACGGTCTCGAGGGGAAGTTTACCCTGGGCACTAGCAGGGTAGAAGTGTTCGCGACCGCTACTG<br>ACAGCGTAGACGCCTACAAGAACGCTATTGAAGCCGCAATACGGAAGAAGGCCGACGACGGCGGCAGGTGGGACCTGGCCCTGGTT<br>CAAGTGAGGCAGAGCTTTAAGAAGTTGAAAGTGACCGAGAACCCCTACTACCTTGGCAAAAGTCTGTTCTTCCTCCACCAGGTGCC<br>CGTCCAGGACTTTACCATTGAGCTGTTGGCTCAGTCCGACTACTTCCCTCGGCTACTCTCTGAATAACATGGCCCTTGCATGCTACG<br>CGAAGATGGGCGGTGTGCCCTGGCTGCTTAAATCTTCACCCACCCTCAGCCATGAGCTTGTGATAGGCATCGGCTCCGCCAACATC<br>GGCCAGGAGAGAGGAGCTGATAATCAGAGAATTATGGGCATCACCACTGTGTTCAGCGGAGACGGCAGCTATATCGTGAGCAATAC<br>ATCTAAGGCTGTTGTCCCCGAAGCTTACTGCGAGGCCCTTACCGCCGTACTTGGCGAAACCATCGAAAAGATTCAGAAGAGGATGA<br>ACTGGCAGAAGGGCGATACCATCAGATTGATCTTCCACGCTCAGGTCAAGAAATTCAACAAGGAGGAAATCGAAGCGGTCAGAGCC<br>GTCATTGAGAAATATCGGGAATACCAGATCGAGTACACTTTTCTGAAGATAAGCGAAAACCACGGGCTTCACATGTTCGATAGTGC<br>AACCGCAGGGGTGCAAAAGGGCCGACTTGCCCCTCCGAGGGGGAAGACGTTCAAGCTGAGCAAACATGAGATGCTGGTTTATCTGA<br>TAGGGCAGAGGGAGCTGCGGCAAGACACCGATGGTCATCCCAGGGGCGTCATCCTTGATGTTCACAAGGACAGTACATTCAAAGAC<br>ATCACCTACCTTTCAGCCCAGCTCTACTCATTTGCCAGCCACAGCTGGCGCTCTTACTTTCCCAACCCTATGCCAGTAACCATTTC<br>ATACAGCGATCTGATCGCTCGAAACCTTGGTTGGCTGAACCAACTGCCCGGGTGGAACGACTCCGTGATGATCGGAAAGATCGGGC<br>AAAGCCAGTGGTTCCTGTAGTAA |
| 77 | ATGCCGAAGAAGAAACGAAAGGTTGAGGACCCCAAAAAGAAAAGGAAGGTGGGGAGCGGCAGCATGAATAACATACCCATCAGGCT<br>GAACTTTTTCGCCCTGAAGAACCAGAACATTAGCTTCAGGATCTACAGGCAGGACTTCAACGGCCAGAAAAAACAGGACGGGTACT<br>ACAGGACCAAGCTGCCCATCAACGACTCTTCTGACACCTACGCGGAGTACTGGGTGACAACCCAGCCCAAGGATGGCTTCGAGAGG<br>GTGTACTGCCTGGGTTCCTCAAACCCTAAGCTCACCGTCCGAATCATGTGGGAGAGCTTCCTGGATAGGGTCCAGAAGTCCCTGAG<br>CTCCGACGAATATATCCTTTACGGTAACGGATTTAGCCGGAAGGTCGCCGATGATCATCGGCAGGCACAGGGAGGGCAATGAGGTGA<br>TCCAGATAGAGCCCTATTACCTGAAGGCCGAGAAGAAGTTCGGCTTTCTGGTGGACTTCGCATTTAAGAAGGCCAAGGACGTGCCC<br>TATAGCATCAGGGTTCAGCAGCTGAGCCTGTCACTGAACAAGTATGGGAAGAGCAACGCCGACTACTATAGCGACAAGCTGGATAA<br>GATAAAGTTCTTTATGCAGAAGTTTAAGCAGAGGCTTTTCCCATTTAGCTTGGATAACGAGGATTACGACATCGAGAACGAGCTGT<br>ATCTGATGAGGAGCTACCCGCTCAAGATGAAGACCTACATATTCTCTAATGGCAAGGAAAGCAACAGCCAGGTGCAGGGTCTCAAA<br>ACCTACGGACCGCTGGCGAATCTCGATAAGGAGCCACTGTTCGTGTTCATGTTCGAGTCCCAGGACAGGAACGAGGCCCTGGAGCT<br>CTATTCTAGCCTGCTGGGCAAGACGTACACCAACATATTTGCTGGCATGGAGAGCGTGTACAAAATCAAACTCGCAAAAGAGAATG<br>TGAAGCACATCATCATCCCCAGCCTTACCAAGGAGGGTCTGCAAGTGGTGGAGCAAGAGCTGCAAACTATCGTGGAGAGTCATCAG<br>GACAAGAAGGTGATTGGGATATTTGTAATGAATGAAAAGGTGCCCTCATCCATCACCGGTTTCAGCCCCTACCACTACGTCAAGTA<br>CATCTTCACAGAGAAACGCATTCCCCTCCAGACAGTGAGGTGCGAGAGGATCGCTGCCAGGGATGGCCTCAAATGGAGCGTTGGCA<br>ACATCGGCCTCCAAATTTTCGCTAAATTGGGCGGCATCCCCTGGAAATCAAGCCGAGTAACGATAAGTGCATCATTTTTGGCCTG<br>GGCTGCGCCCACAAAAAAGACGAACTGGGAAACATTAACAAATACTTCGCCTACAGCGTGTGCATGGACAGCAGCGGCATTTACCG<br>AAAGATTAATGTGCTCGGCGATGCAAAGGAGCGCACTGATTACATCCTTCAACTGCGGGAGAACATCAAAAGCGTGATAAGCGAGA<br>ATCTGGACGGAGCATTGAAAAGTGCGTGATTCACCTGCCCTTCAAAATTAAGAACGACGAGATCAGGTACATAAAATCCAGCGTG<br>CAGGAGATCGCGCACCTGTATTCCGACATAGAATTTCAATTTATCAAGATCAACACGACCAACAAGTTTTTCGGATACGCTGAAAA<br>CAACAGCAAGGTACCCTACGAGAGCAGCTACATACAACTGAGCAGCAACGAGTTCCTGGTGTGGTTCGAAGGCCTGCAGTACGGGA<br>AGGAGCTGGTGAAGAAAAGGTAGGTAACCCCGTGCACATTGAGTTCATGCGAGATCGATGAGTTGGATCCCGAAAAGAAGCGGCGA<br>TATCTGCAGGATATCATAAACCTGAGCGGTGCCAACTGGCGAGGTTTTAACGCCAAACTGTCTCCAATCAGCATCTACTACCCCAA<br>CATCATAGCCAATTTCATTTCAGAGTTCAGGGAGTTCCAGCCCGAAGGCGACGTGGACCTGACCAACTTTTACATTCCCTGGTTCC<br>TGTAGTAA |
| 78 | ATGCCCAAGAAGAAGCGCAAAGTAGAGGACCCTAAGAAAAAACGCAAGGTCGGCAGTGGCAGCATGCATAACATCGAAATCAACAC<br>CTTCGTCAACAGCTTTGCCATTAAACCCAACAACTCCATGTCCTTCCTGCTCGGCGCAGGCGCGTCTATATCCTCCGGGATCCTGT<br>CTGGCGGACAGATGGTGTGGGACTTTAAACGGAACCTCTATTGTGCGTCCAAAAACATACGCACCAGCAATTTTCCCGATATGAGC<br>AAAAAGAATGCGCAGGACGAGATCCAACGCTTTTTTGATGGGCAGGCCGGAAATCCTAGCCTGTGGTCCTCCGAGGAGTATAGTTT<br>CTACTTCGAGAGGTGTTATCCGGCGAGGAAAGACAGGGAGCTGTACATACAGAACAAGGTACGAGACGTCAAGCCGTCATTGGGGT<br>ATCTCTGCCTCGGGGAATTGATCATACACGAGAAGATCGGTGTAGTATCAACCACAAACTTTGATGACCTGGTGTTGGCCGGCATC |

TABLE 17-continued

Argonaute nucleotide sequences containing 2X Nuclear localization sequence (NLS) from Simian Vacuolating Virus 40

| SEQ ID NO | Sequence |
|---|---|
|  | CATTCAATAAGACCGGACCTGAGTGTGAAGACCATCAGCAGTGCCCTCAAAAATAGCACGGGATTCTTCGTGAACGACGGGTTCCC GAACATCATTAAGCTGCACGGCGATTACTTGTACGATAAGCTGGAAGAATACCGATAAGGAGCTGCAAAAGCTCGAGACGGAGATCA GCGGAATTTTTCGAGATGCCGTCAAGAGTGGCGGGCTCATCGTACTTGGCTACGCCGGCAACGACAACAGCGTGATGAGCGTCCTG GAGGAGCTCGTAAGCTCCGGGCAAATCAGGTACGGCGTGTTCTGGTGCCAACCGAAGGGCTTCCCCCTGTCCAAGCGAGCGCGGGA GTTTATTGAGAAGGCTTGCGCCTACAATGAGGAATCCGGGGTTGTCGAGATCAACAATTTTGACGACTTTATGTACCGCCTGTTCC TTACACTCAACATCCAAAACTCATTTATCGACAGCATGTGGGAACAGAGCGGCATGAAGCAGCCGATCCTCTATGAGAATATCGGA CGACACAAGTCCACCGCCGTGACGAACGCCCTGTGCGCCCTGCAGTACCCCCGAAAATGCTACGTCTTCAACGCGAATATATCAAG CTGGAAGGAACTGCGCGAGACGATAAACGACACGTGCGTGGCAGTGCTGTATAAGGGCATGGTTTGGGCGCTGGGCAGCAAAGCAG GCATCGTGCATGCGTTCGCCGGGAAGATCAATGGAGACATATACGAACTCGACATCCCGTTGTACATGATGAAACTCGAGGATTCT GACATCCTGGGCATGTTTTACGACATCATAGGACGCGGCCTTCAGCGAAAGGGGCTGGTGAGCTACGGTAATAGGAAACATCACAA ATACTTCAACCCCTCCAGCAAACGGTTCAAGAACGGTCAAAACATCTACGACGCGGTCAAGATATCACTGAGTTTCGTGGACGATC AGCTCGTGCTCATCCTGCTGCCTACGGTGCATCTGCTGAAACGCGACGGGACGGAGCTGGAGAAATTTGACTACCAAAAATTGGTG TCCCAGGAGATGGCAACACACTACAACAAAGTGGTGGACAGCGAGATAGAGATCTGGCTGAAATTCATCTCTAATAACGGCAAGAT AATCTTTGAGCTGGGGAACGCAATACTGGAATTTAACAACGTCCGCATCCAGTACTCTGGTAACGGTAACCTCAGCAAGTGCTACC AGGTGAGCGAGCCCGAGCTCACGTTCAGTTACGAAAAGGACAACTGCGATCGCTACCAACCAACTGCGGGGTCTGATCAACTATGGA CCCATAGAGACTTACGTGAACAAAGCCATCAGGTTGGCTGTACTCAGCCCTAAGGAGTGTGCCGCGGACATTTGGAAACACCTGCA GAAGTTGAATGAGCATCACGTCACCTCCCTTATTCAGGATGCAAATTTTCTGCCGGAGTACACCGGCTTTCAGAACGTTTTTAGGT GCAACCTTGACATTCCCAATGGGAACGATGTGCATAGGTTCAAAGGCTACAGTATAGACAAGGTCATGCAACTCAACGCAAAGAGC TACTTTTACGGGATCTGCAAGTACATTGATGCATTCGAGACACAAAGGAGCCAATACGACCTCCTCGTCATCTATATACCTAAGCA GTTGACCCACATCCGAGAGGCCAAGAATAACTTCGAATATTTCGACCTGCACGACAGCCTGAAGATTTATTGCGCTGGTAAAGGTA TAGTCACGCAGATCATCGAGGAACACAGTGTTTATACTAACAATGACACCGCCAAGATCATATGGGGTCTCTCAACGGCATATTC ACCAAGACCGCCGGAAGGTTGTGGAAACCCAGACGCTATTCCATGAACACCGCTTACGTCGGCCTGTCATATGTGCAGAGCGTTAA GAACAACGAGAAAGTCAGCATCGGTTGCAGTCAGCTGTTCGACGCGGAAGGCAATGGAATGAAGCTTTACCTGAGACCCTTGATGA ACCCCCAGATAATTCAAAATAACCCTTTTATGCGGAGCGACGACGCTTGCAGGCTTATGTCAAACCTTAAGCGGATGTATGACGAC AGTGTCCCGCTCTACAAACTGAATAGGATCGTGATCCACAAAACTACGTTCTTCACTAAAGAAGAGATGGAAGGCATCACCAAAGG GCTGGCTGGAGTGGATGACATAGAGTTGCTCCAGATCCAGGAGTTCACAGCTTGGCGAGCAATACGCTTCGACTACGACAAGATCG CACCGTTTCCGATACAGAGGGGCACAGTGATTCTGGGGTGGGGCCACTTTAGTTACTTGGATACCTGGAAGTGTACCACCTAGTAA |
| 79 | ATGCCTAAGAAAAAGCGAAAGGTCGAGGATCCAAAGAAGAAACGGAAGGTGGGCAGCGGCTCCATGCAAGAACACCTGAAGACGAA CATACTGAACTTTAAATGGCCCAACTCTGCTCCGACCATCTACCTGACATTGGAGGACATTGAGGGGAGCCACCCTATCCACAAAA GCAAATTTTCTAGACAGATAAAAGAAGTGTTCCCCGACGCGGATTTGAGTAACAAGGACCAGATCTTTACGACATTCACGACCGAA ATCCCAGACGCCCCAAGCATAAAACTGAACCTTGTGGACGGCCGAGAATTGCGGATCTATAAACAGTTCCTCAAGCACAAGCTGCG GTCATATTTCAAATCTAAGGACTACATCGTGGTCAAGAATTTCGTGGGCGACGTTCAAGTGTGGATGCCGAGCAAAAAGGGTAACA CCGCAGATTACAACCTGTACTATAAGTTTAGCTTTAAGATCCAATTTGCCAAACTGACGGACCTCCCCGAGCTGATCGTAAGCTAC GATGGCACCTCCAAGGTGCTCACGACGTCCGTTAAGGACATCGAAGATTCAGAGCTCATCAAGCGATGCGTCTACGGCAAAAGAC GTTTAACTACCAAATGGACTTGGACACCGAAGAGAAGCAAGAGTTTTACAACGCGATACAGTTTGACCAGCTGTACCCAATTTTCA ACCTTTCCCTGGCAAGGGCACTCGACATCCCCATAGAGGAGCCAATAAGGCCGATCAACAAATACCAAAAATACGTAGCCCTGATT AACAATTTCGCAACTAATTACCTTTTCAAGGAGGACTTCAAGGTTATCTTCCCGTTTAAAACAGACACGTTCATCGACGTGCCTAT AAATCGGATAAATCACATCGACCCCCAAGTCGGCCTGTTGGAATTCGGAAAAGATCAATATGGCAACAAGAAAACCCACCTGGTAC CTAAAAAGGCAATGAACATCTTGAATCCATACCGGCGACCTAATAATCAGACATCAAAATCTTTTTCATCTGTCACACAAGCCAC AAAGACTCCGTGCTCAGCTTCTATCAGAATCTGAAGGAAGGAGTAAACACGGAGAAGAACTACTACAAAGGACTTGAAGCCTACGT GAACATTAAGGCAAGTAGTAGCAAGGAGCATTTTATCGAGTTCACGAACGAGAATGACCCCATCCCGGAGATCGTGGAGAAGCTTG AGAGCCTCACATTTGATCATGACAATGTTCTCTACGCGGCGTTCTATCTCTCCCCCTTCGACAAATTCACCCAGAATCCGGAGGAC CGGGAAATTTACATCCAAATAAAGGAGTTGTTCCTGAACGAAGGTATCGTGACCCAAGTTGTCGATTACGAGAAAATGGTCGTCAA TATCGAGAATCAGTATAACTTCCAGTTCAGCCTGCAAAACATGGCCCTCGCCATTCATGCTAAGCTGGGCGGTGCCCGTGGAAGC TGGCCGTGACCGACAAGAAGGAATTGGTCATCGGGGTTGGAGCGTTTACAAATCAAGGCGAGAACAGACGCTATATTGCTTCCGCC TTCTCCTTTCAGAATAACGGCCTCTTCCGCAAGTTCGAGTACTTCGATCAAAGCGAGACCGACCTCCTGGCTGGCAGTATCTGCAA AGCCATCCGCGACTTCACCAGCGTAGCGGAGGCAGATAAGGTCGTATCCATTTCATTTCATAAGGATGAGTTACGAGGGAGCGTTAAC CCATCATTCGGGGCATGCACACGCTTGGGCTGAAGATACCCCTTTACATACTTAACATAAACAAGACTGAAGCCGAGGATATTATC GCCTACGACCTGAATTGGAACAAAAGCTGATGCCCGTCAGCGGCACCTACATTCGCATCTCCGAAAATCATTTCCTGCTCTTCAA TAACGCACGATATCCTAATTCCCAACGGTACGCCGACACGGATGGTTACCCGTTTCCCATTAAGATTAAGGTCAGCTCTCCGGACG AGGATGCCTTTGAAGATGCAGATGTGGTCCTGGAGCTGCTTACTCAGGTTTATCAATTTAGTAGACTGTATTGGAAAAGTCTTCGC CAACAAAATGTACCTATCACCATCAAGTACCCAGAGATGGTAGCCCAGATTGCCCCCCATTTCAACAACGGGGTGCCCGACGATGC CAAGGATGCTCTGTGGTTCCTGTAGTAA |
| 80 | ATGCCTAAGAAAAAACGGAAAGTGGAGGATCCCAAAAAGAAGCGGAAGGTCGGCAGCGGCTCAATGGCCTATCCAATCGCTGACGA CCGGCGAAAGTACTTCCACAGTCTTTTCGAGAACAAGGAGCCGTACATCGGATACAAGGCTCTGTGTCTGCTGGCCAAGAACGACA TCATCAAGAGCGTGTGGACGACCAACTTTGACGGGTTGACTGTGCGACCGCATTCCAAAGTAACTTGACCCCATAGAAATAACC CTCGACAACGCAGACAGACTGTTTAGGAACAAAGCAAGAGAGAGCTGCTGAGCATATCACTTCATGGCGACTATAAGTATAGCAC GCTGAAAATACCGAGAAGGAGTTGGACTCACAGGACGGCACCTTCAGCGAGCATCTGGGTAACTATCACGTCGACAAGAACCTGA TTGTGATAGGTTATTCAGGGCGCGACAAAAGTCTGATGAAATCCCTGAACGATGCATTCACCAAGAGGGGCACCGGCAGGCTGTAT TGGTGCGGCTACGGTGACAAGATCAACACTGAGGTGGAAGAACTTATACGCAACGTACGAACCGCTGGAAGGGAAGCCTTCTACAT ATCCACCGATGGTTTTGATAAGACGCTGATCGACCTTTCTAAAAGCGCTCTGGAGGACAACAGCATGAGCCTCGAAAGCCTTAATT CCATCCTGAAACTGGCAAACAACGAGGAGCTCTCAAAGATCGAATTTAGCCAGAGCATCACCAGGACCGACAAATACCTGAAGAGT AATCTGCACGCAATTGTGTTCCCCAAGGAGATATTCCAGTTTGAAGTCGAGTTTGGCGACAACAAGCCCTGGTCATTCCTTAAAGA CAAAACTAACAACACCGACATATGCGCCATCCCCTTCAAGAGGAAGGTTTACGCCCTGGGCACGCTCAGCGGTATATCTAGCGTGT TCAAAAACGTGCTCAAAAGCGAGATTAGGAGGTACCAATCTCCAAGTTCGACATCGACAATGTGAGCAGCTTTAGGTCTCTCATG ATCCAAACGGTGATCAAGCACTTTCTGTCATACGGAATCTTCGACAGCAACCTCAAGGACAAACTGTGGCTTAGAAATTCCGACAA TTCCTTCGGGGACAAGAAAATACACAAGGCGATTTACCTCAGCTTCTACTTCGATAAGAGCCAACGGAATTTCAGGCTACATTAGCTTCA GCCCCAGCATACACATAACCTCCGATAACGAGATCAGCAAGGAGGTGAAACAAAGGATTAGCAAAGAGATCTTGGAAAAGCTCCGA AACGATAAGTTTGACGAAATACTGGAGTACTGGAACACCCATACTGTTCAATTACAAAAATCTTAAGTTCGAGTACCCCTTAACAG CGGGACCGGATTCGAGTTCCAAATAAGCCGAAAACACTGCGTTTGCCGAAATCATGGTGCTGGACCCGAACTATCGAGTCTATAAAC CAAGCGATTACAACAACAAGCTGACCCAGTTCAGAGGTGTGCAGTATCTGGAGCCGCAACTGATCTTTCAGAACTCACTGAGTAAC TCCCACACCAAGGACTACCACCCCATGAGGGCGTTGACCAATAACAGGCCATACGACAACAACTTGAATGGCATCATCTATTCAAA |

TABLE 17-continued

Argonaute nucleotide sequences containing 2X Nuclear localization sequence (NLS) from Simian Vacuolating Virus 40

| SEQ ID NO | Sequence |
|---|---|
|  | CGAGGTCAATTTGGCCGTGATTTGCGGGGAAAACTACTCCAAAAACCTCTACGACTTCCTGAACCAGCTTAACCTTAAACACCCCA<br>CAGACAACATCAACCCCGATTTCCTTATAGAATATCCTGGCTTCGCGAGCGCCTACAACCTCCCCATCAACCTCCCATACTATGAG<br>GACGCGGACAAGTGGATTAACATAGATTTGGAGAAGAGCAACAAGTCCGACAGCGAGAACGCCATCATCGTTGCACGCCTCATCAC<br>AAGCAAAATCGAGCAGATCATAAACATACAGTCTCAGCACACCATCGTCATCTTCATCCCCAAAGAGTGGCAGGCCTTCGAGAGCT<br>TCCAGGAAAATGGCGAGGACTTCGACCTCCACGACTACATCAAGGCGTTTAGTGCATCCAAGGGCGTGAGCACCCAGCTCATCAGG<br>GAGGAGACACTGTCAGACAGGTTGAAATGCCAGGTCTACTGGTGGCTGTCTCTGAGTTTTTATGTAAAGTCTCTGCGCACGCCATG<br>GGTCTTGAATAATCAGGAGAAAAACACCGCCTACGCCGACATAGGCTACAGCATTAAGAAGAACAGCAATGACACCGAGGTGGTGA<br>TCGGTTGCAGCCACATTTACGATTCTAATGGCCAGGGCCTGAAGTACAAGTTGAGTAAAGTAGATAATTACATCCTGGATAAGCAG<br>AGCAATCCCTTCATGAGCTATAATGACGCGTTTCAGTTCGGCGTGTCAATTAGGGAACTGTTCTACAATAGCCTGGACAGGCTCCC<br>CGAGAGGGTGGTTATCCATAAGCGGACCAAGTTTACGAACGACGAGATAAAAGGTATTACTGCCAGCCTCAACATGGCGGGGATTA<br>CCAAGATAGATCTCATTGAAATCAACTACGAGACGGAGGCTAGGTTTCTCTCCATGAACGTATTCAACGGCCTTCTGGGCATAGAC<br>AAATTCCCTATCAGTAGGGGTACCTGCATTATTACGAATAAGTACGAAGCCCTCCTTTGGACCCACGGCATCGTGCCCTCCGTGAA<br>GAATCCCATTCACAAGTATTACCTGGGCGGCAGGAGCATCCCAGCCCCGATCAAAATTACTAGGCATTACGGCGAGAGCGATCTGA<br>ATACTATTGCCATCGAGATCCTCGGCCTCACCAAAATGAATTGGAATAGCTTTGACCTTTACAGCAAGCTCCCTGCGACGATTAAC<br>TCCTCAAATCAGATAGCCCGGATCGGTAAGTTGCTGGCGCGCTTTGAGGGCAAGACCTATGATTATAGGCTCTTTATTTAGTAA |
| 81 | ATGCCCAAGAAGAAGCGAAAGGTAGAGGACCCAAAGAAAAAAGGAAGGTGGGCTCCGGATCTCTGGACAGTTTCCACCTCGTGCA<br>GACAGAGAAAAAGGCCATCGCAATGCCAAAGCAGAAGCTTGCGGTTAATGCACTCCCCATTAGCCTGAAAGAGCAGGAGCAGCACA<br>AGCTGTTCTTTTTAGCAAGGAAAAGCAGGGCGAGCGAGCCCCGCTCACCAGGAAAGAATATCCTGACAGCTTCAACGAGGTAC<br>CCCAAGAGCTCCAAAGAGTACGACGTGCTGTACACGGACTTCACCCCAGAGCCAGCTGAGGATGGGTTTGAAATTGATATCGACCT<br>GGAGGAGGCACCTGGCCTTGCCAAGCACTACTTGCACAAAAGGATCTTTGAGGCCTTTAAGGGAGTAGCTGACTTCAGAAAGCGGG<br>ATTTTCATCAACGGTGTGGAGCTTTGGTTCAGGGACAAACCCGCCGACGAAGTTAATTTCCGGGCCTACAAGAAGTTTAAGATTACC<br>ACCCGCAGAACTTGGTTCTCCGCAGGCTGGGCCCTGTTCATACAATACACCGGCCATTCCTTTATTCACCCGGTGGCGATCAATAG<br>CGAAGAGGCCGCAGTGGACACTACGGAACTCACGCGGGTTGCTTATAACCGACACATCTTCCACTACGAGGAGATCCCCGAAGACA<br>AACTGAGTGAGATAGATTTCAGTAAGATGTACCCCGTGGTGAACTTCAACATTAGGGATAAAATGCAGCAGTTCCCCGTTATCGAT<br>CCATTCAAAAACAAGGTCAAGGAATATGTCGACGAAATAGACAGGTTCAAGAACATGTATCTGATCGCGCCAGCGGTTGAGGAGGT<br>GCTTCCGTTTACTTTCAACGACGACAACTGGTGCGAGATCAAGATCGGCACCTACCATACCGTGCCCAATGCCGGTTCCAAATTGG<br>TTTTCCGCGATGGGCAAACCGAGATACACCCGTTCTACGGTATCAGGAACCACGGCCCTTTCATGCCCCCAAACACAGCCACATA<br>AGGTTTTTGTTTATCATGAGCAAGAGGGACATCAAGGGCGCTGGTAAGCAATTCTATGAATACTTGAAGGGGGAGGTAAAAGGAGT<br>GGACGGGTTCAACAGGTATGCTAATATACCGTCATCCCTGAGGGGTGAGATGATCGAGTTTGAGAACGAGCAAAACCCCCTGCCGG<br>AGATTATCGACGGCTTGAACAACATGGAGCGAGAAGCGGGCGTGGCCTACTTCGCCTTCTATATCAGCCCCCATCGACCGAGAAGTG<br>AGGAACAGGAAGGAGGAGGTTGGTGTACTACAGGGTTAAGGAGGAGCTGCTGAAGAGAAAGATTGCCTCACAAGTGGTAGAAAGGAG<br>CACTATCGAGAAGGCCGACTTCCGCTACAGCATCCCCAACATCGCCGTTGCCACAGTGGCCAAGCTGGGAGGCATCCCGTGGAAGC<br>TTACTCAACCCCCAGAAGCAGAGCTGATCGTGGGCATAGGCGCATTCCAGCCACGCGAGTTCGACAAGCGATATCTGGGCAGCGCC<br>TTTTGCTTCCAAGGCGACGGAACCTTTAGCGGCCTGAGGTGTTTCACCAAGGACGAACCCCATATGCTTGCTGGCAGCATCAGGGA<br>AGCGGTTCAAAGGTACGCCGATGAAAACAGGCAAGTGGAACGGCTGGTTATCCATTTCTACAAAACCATGAGCTATGACGAGAGGA<br>AGCCGATCCTGGCCACCTTGAAAGAACTCGGCCTGGACATTCCCGTTGTGGTGGTCACTCATCAACAAGACTGAATACGAGCAGACA<br>ATCCTCTTTGACCTGAATTCTAGCATGAGGCTGCCGCTGAGTGGTACCTATTTCAGCCAGCGCAGGGACGACATCCTGCTGAGCAA<br>CAACACCAGGTACCGCAAAGACAGCGAGGTGAAGAGGGGGTTTCCCTTTTCCCGTGAGACTGCAGCTGTGGTGCTCCAAGGAGGGCC<br>TGCTGGACGACGAGGGTTTTAGGGAGCGACTGATCACCCAAGTGTATAGGTTTTCTCGGCTTTACTGGAAGAGCGTGTCTCAACAG<br>AATCTGCCCGTGACCATTAAGTATCCCGAGATGCTGGCCGAAAAGTTCCCATACTTTAACTCAAGGAGCCTTCCTAGCTTCGGCGA<br>AAAAAGCCTGTGGTTCTTGTAGTAA |
| 82 | ATGCCTAAGAAGAAGCGGAAGGTGGAAGACCCGAAGAAAAAACGAAAGGTGGGCTCCGGAAGCATGAACAACACCATAAACAAAAT<br>AGACTTCGGCGCGTTTCTGAGATCATTCAAGCAGAACCTGGACGGTAGCTTTTCTTTCCTTCTGGGAGCAGGCGCGAGTGTGAGCA<br>GCGGCGTACAGTCTGCAAGCGACTGCATTTGGGACTGGAAAAAGACATTTTTCTGGCCAAAACCTTCAATTTGAGGAGTTTCTG<br>GACATCCATAGTGACTTCTGTAAAGATAAAATCCAAAAGTGGTTGGATGAGCAGGGCGTGTTTCCCAAGCGAGACTCAGAGGAAGA<br>GTACGTGTTTTATGCCGAGAAAGCGTACCCAATGGACAGGACAGGACCAAGTATTTCGAGAACCTTTGCGCGGACAAAACCCCCT<br>ACATAGGGTATAAACTGCTGATGCTGCTGAACAAATACGGAGTTCTGAAATCCGTGTGGCAACGAATTTTGACGGTCTGATAGAA<br>CGCGCAGCGCACCAAGCCGATCTGACGCCCATCGCCGTTACCCTCGACAACCCCGAAAGGATTAGCGAAACGAGAGTAAATCTGA<br>GCTGCTCTACGTGGCACTCCACGGTGACTACAAGTATAGCAAGCTGAAGAACACAGCCCAAGAGCTGGACGCGCAAGAAATTCTCT<br>TCACCGAACGCCTGAAGTCTTACTTCATCGATAAGAATTTGGTGGTGATCGGTTACAGCGGTCGAGACAAAAGTTTGATGCACACC<br>TTGTGCGAGGCTTTTATGACGAAGGGGTGCGGTCGGCTTTACTGGTGCGGCTACGGTAACAAGATTACCTCTGAAGTGCAGAACTT<br>CCTCAACAGAATAAACGATTCAGGTAGGGAAGCCGTGTACGTGGACACCGATGGGTTCGATGCCACCCTCGTGTCTATTATGAAGT<br>TTTGCTACGAGGATCAATTCGACAAGAAAATCGAAATCGGCAAGTATCTCAAGGGCCTGTCAAGGGTGAAGCATATTATCCCTTTC<br>AGCGTTGAGAATACCACGTTCACCGGCTGCGCCAAGACCAACCTGTACCCCTTGATCATCCCCCAAGACATATTCCAGTTCGAGAT<br>AGAGAGCCCCGAAGGTAGCAGCAAATGGACCTTCATTAAAGAGAAGATTAAGGGCAAGGACATTATCGCTGCCCCTTACGAGAAAA<br>TAGTCTACGCATACGGGCTGCCAAACTCAATCTACAACGTATTCAGTAAGGAGCTGATCGGCGAGATCAAGAGGGTTCCCATCAGC<br>CTGAGTAACATCAAAGACAACAGCACCCTCAAGAATATCATCCTGAAGGTGCTGATATGTTCTCTGAGCAGTAACGCGGGACTCAG<br>GGCGAGTATGAGCAAGAAGATCATCTGGAATGAGAAAGAGAGGTTCCAGAGCAACGTTTTTAAGGCAATAAAGATCGACATCGTTT<br>TCATCAATAGCGAAAAGTACGCCCTCATCTCAATCACCCCTACCCTCTATTTCAACAAGGAGGGCAACTACACGACGCTGCAGAAG<br>CAGGAAATTACGCGGAGCTACATTGACAAGCTGTACAATAAGATTTATGAGGAAACCCTTTGTTACTGGGAGGCCATCCTGTTTAA<br>GCAGCAGACCAAGATCTGCTTCGACTACCCGCTCAATTCCGGGAACGGCTGTTTCTTCAAGGTTAGCTCTAACAGGGGCGAAGCCC<br>TGTTCAATAATCCGAATAAGCCGTACGTGATTACTAACGACATCATACTTAAACGCAAATCTACGAAGGCATCATAATCGACGAG<br>CCCCTCCTGAACTTCTCAGGGTCAACCAGCGCCCACATCATTATGAGACTCCAATCCGATGCGGTCTCAACAACAATAACCCATA<br>TGATCACTTCATTGCAAGCAAGTTTAGGGACGTTTCTATCCACATCGGAGTCGTGTGTCCCTGTACATATAGCGACAGGTTTTTA<br>GCTTTCTGAACGAGCTGCAAAGTCCGATAAAGAATAACAATCCTAACTCAGACTACATCCAGAACTATAACGGATTCAGCCAGATA<br>TACGCAAGCATTCTTAATATCCCAGCGATCAACAGCCAATACTGGATCTCATGCCGCGAAGAGCAGGATAACAGCATCTCTTTGGC<br>TAGGAACCTGTGTAAATACGCGAACCAGATGGCCACTAACATGCGCAGCTGGTATAATAGTTACCTTCTTCATTCCTAACAGCTGGAGCA<br>ACCACAAGAGTTTCAAAGAATGTGGCGAGGTATTCGACCTCCACAGTTACATCAAGGCTTTCGCCGCACAGCACGGTTTTACAACC<br>CAAATCATTGAAGAGCGAACTCTCACAAATCTCTCCATGAAAAGGAGATCTATTGGTGGCTGAGCCTGGCGTTCTTTGTAAAGGC<br>TATGCGAGTACCATGGACCCTGGCCAATCTGGACCAGAACACCGCCTTCGCCGGCATCGGCTACTCCCTGAGCAAAAAGCAAAGCG<br>GCAAATTCAATATCGTTATCGGCTGTAGCCACATATCTATAATTCTGAGGGCAAGGCCTGAGGTACAAGCTCTCAAAGATAGATAAT<br>CCAATCTTGGACCGGAAAAACAACCCGTACCTGACCTATAATGAGGCGTATAAGTTGGGCGTGAACATACAGAATCTGTTCATTCA |

TABLE 17-continued

Argonaute nucleotide sequences containing 2X Nuclear localization sequence (NLS) from Simian Vacuolating Virus 40

| SEQ ID NO | Sequence |
|---|---|
|  | GAGCATGGACAAACTCCCGAAGCGAGTAGTGATCCACAAAAGGATCCCGTTCCTGGAGGACGAGATAAAGGGCATTACCGAGGCGT<br>TGGCCCAGGCCAACATCACGAATGTTGACCTCATCACTATCACGATCGAAAAGAACATCAGATGCCTGGATCAGTTCTTCTACAAT<br>GGTCAAGCCAAGAACAGCAACTTCCCACTGCATAGGGGCACCTGCATGAAGCTCAGTGATACCGAGTGTCTGTTGTGGACCCACGG<br>CGTGGTGGACTCAATTAAGGCGGGCAGGAACTACTACTCTGGTGGCAAGGGTATCCCCTCCCCCTCCGCATATCAAAGTTTTACG<br>GCGCAGGCTCTATGAAGACTATATGCAACGAAATCCTGGGGTTCACAAAGATGAATTGGAATAGCTTTAACTTCTATACCAAGCTT<br>CCCGCGACCATCGACACCAGCAACACGCTGGCGCAAGTGGGGAACATGCTCGATAATTACAACGGTATTACATACGATTACAGGTA<br>TTTCATCTAGTAA |
| 83 | ATGCCCAAAAAGAAACGCAAGGTCGAGGACCCTAAGAAGAAGAGGAAAGTAGGGTCTGGCTCTATGCAACTGAACTATTTCCCCAT<br>CCAGTTTGACTTTTCTGACTACCAGGTCATCACGCAGCCCTACTCCGACGAGAGATTGAAAGAACTCAGGCAGGCCTACAACGCCA<br>GCTATTCCTTCTTTCGGGACGGCAACCTTATCGTAATTTCCAATAAAGAGGACGAGGAAAACCAATTGACGGGCAACGTCGAAAAC<br>CGCAGCGTGTTCGACGATGCCAAAGTTACCGCCAGCATGGTCAAGCATATATTCTTTAGGACGTTCAAGGACAGGTTCCAAGGCTT<br>CATCCCCGTGGACTTTTACCCCTTCCGATTCTACAGCAGACAAGAGAAGGACGACCTTATTCTGAACCACCTGCCCGAAAAACTTA<br>AGCATAAAATCGCCTTTAAGAAACTGATCGAGGTGCAGCTCAGGGAGACGAATCTTAATTCAACCCAGGGCTTTGCTTTCGTCGTC<br>TGCGGAGACGCTTCCCGGGTTGGACAATATCCTGGCCCCGAACGAGGACTTCGTTGGCCTTCTCAAGAGCATCAACGGCGAGACTG<br>CCATTGTGAGCACTAGCGAGGGTGCCCGCTCCTATTCACTGCAGGAGCTCTTCATTCGCAAGACTAAGCACAACATACAGGCGTAC<br>CTCAACTTCGCCACCGGGGAAAAAAGTGCGACCAGATCCTTGCAGCCGTGTCCCAGGAACGAATCCGGAAGCAGAACCCCGTGAA<br>TCAATTCAGCGAGATATCCAACATCGCGAAGCATCTTTTTTCAGACAAAGGCAATCCAGTGCTGTTCCAGAATATGGATGGCTTTT<br>GTTTTAAAGTTGACACCACGCCGATGCAGGTACAAAACTCCATGAACCTGCAAACTCCCACGTTCATCTACGACCACGCGGGTACC<br>AAGACGAACACCCGCAACGCGGACCAGGGGCTGAGCTACTACGGCCCCTACGATAGCCTCACCTTCGACATTAAGAAGCCAAGAGT<br>TCTCTCTATCTGCCATAAGACCAACCGAGGCTCCTTTACGCGCTTCCTCCACGACCTCAAAGACGGGCTCCCCAATAGCAGCTGGT<br>TCAAGAAGGGCCTCCTGAAGAAGTACGAGCTTCAAGAGGTGAATTACCTCATCCAGGAGATCAGCGACTACAGGTTGGAGGACTAC<br>CTGGAAGTGATCTCAAACTACGATGATGAGAAACCGCACCTGGCATCGAAATTCCAGATAGGTTCAAAAACTGTCGACCG<br>GGACAACCCCTATTTCAAGATTAAGGCAAAGCTGCTGAGCCTTGAGATTCCCGTACAATTTGTGCGCAGCACGACTTTGAGCAGCT<br>ACAGCGAATACATACTTAATCCGCTTGCATTGCAAATCTATGCGAAACTCGGCGGCACGCCTTGGGTTCTTCCGGCCCAACGCTCC<br>GTTGACCGCGAAATCGTTATTGGCATAGGTCACTCATGGCTTCGGAGTGGCATGTATAAGGGTGCTGAAAACAGCAGGGTGGTCGG<br>CATTACTACGTTTATGTCTAGCGATGGCCAATACCTCCTGGGCGACAAGGTGAAAGATGTGCCTTACGAGTCTTACTTCGAGGAGT<br>TGCTGAAGAGTCTCAAAAGTAGCATAAGCAGACTCTCCGATGAGTATGCCTGGCAGGATGGCGACACAGTGCGCCTCATTTTCCAC<br>ATCTTCAAACCCATCAAGAACGTTGAGTTCGATGTCATTAGCCAGCTTGTGAAGGACATCAGCCAGTTCAACATAAAGTTCGCGTT<br>TGTGACCATTAGCAAGTCACACCCGTCTATTCTCTTTGACACGAGTCAGCAAGGCGAGAAAAAGTACGGCTCTAACCAGGTGATAG<br>GGCAGTACATCCCTCAGAGGGGTAGCAATATCTTCATAGATGACGAAACCAGCCTGGTGCAGATGCTGGGCGCCAGGGAACTTAAA<br>ACTGCCAAACACGGGATGAGCACCCCAATCCAAATCAAACTTAGGACACCGCAGGGTAACCATAACGACCAAGAACTGAAGGATTT<br>GATGTTTTACGATCTTAACTACATTACCCAGCAGATCTATAGTTTTACTTACTTGAGCTGGAGGAGCTTTTTGCCACGCGAGGAAC<br>CGGCCACAATGCTCTACTCCAACTTGATATCCCGACTTCTTGGGAAGATGAGGAGCATCCCTGAATGGGATGCGGATAAGCTCAAT<br>TATACCCTTAAAAGGAAGAAATGGTTCCTGTAGTAA |
| 84 | ATGCCCAAAAAGAAGCGGAAAGTCGAAGACCCCAAGAAGAAGAGAAAGGTGGGCTCCGGCAGCGTGGGCGACAAGACCTTCAGCTT<br>CAAGGTGTATAGGAAACTGAAACAGCAGAACGACACCAAGGAAGACGAGATATACCTTTACAATTTGCCCCAAGGCGAGACCCTGA<br>ATGATTACAAGCCATATTGGATCAGTTTTACCCCGAAGGACGGATTCGAAGAATACATCGCTAATTCTTACTTGAGCATCGGCCTG<br>TCAAAAAAGTACCTGTTCAATAGATTCGTGGAGACGCTCAGCAACTGCACTTCACCTACAAGGTCAAAAGGAAATTCAC<br>CGACTGGTACGTCGATTTCGTAATCGCGCAGTACAGCCAGGGAGACAGGATCATCTACATGAGCCCCTACTTCCTGGAAGAGCAAA<br>ACACCTACGGCTTCATCATCGACTTCAAGTTCAGCAAGAAGGATGGTATCCCCTTCGATAAGGAGGTGCAAAAGCTGTCCCTTTCA<br>CTGGATAGCAACGGCCGCAGCAACAAAAACTATTACTCTGACAAATTTAGGCTGGTGAACAATTTCATTAAGGAGATTTACACCTC<br>CATAAAGAACATCGGGACCAGTAATAATCCTATCACCATTTCCAGCAACCTCATAGAGACCCACCGTGTTCCACCTGACAAGAAAG<br>AGTACATCTTTAGCAATAACAACGTAAGCTCTAGCCAGTTCCAGGGCGTGAGGAATTTCGGTGTCTATAAGAATATCCCCCAGGAC<br>GTGATCTTCGCGTTCATATTCGAGGATAGGTTCAGGAGCTTCGCCAACGAGCTGTATCTGAGCCTTACCGGAAAATTGAACCCCGG<br>GACCTTTCCCGGACTGGAGCAGATGTTCGGCATCAGCATCAACACCAAAAACGTGAGACAGATCAAGTTGGAGAACTACTCTCTGG<br>ATTCAATGCTTAGGGTGGTGGTGAATGACGTGAAGAGCTTGCAGGAGACAATCCCGATAAGAAGATCGTGGGAATCTACGTGGAAGAC<br>TGCACCATCGACAGCGAGGACATCCCTGCGTCCAACAACTACTACTTTCTGAAGTATCACTTTATCAAAAATGACCTGCCACTGCA<br>GGTTGTGAATTATCGGAAGCTGGGCGAAAGGAATTCTCTGAAATGGAGTACCTCCAACCTGGCCCTGGCCATGTTCGCAAAGATGG<br>GCGGCATCCCCTGGGTCGTAAAACCGTCTAATAAGAACTGCTTGATTCTTGGCATCGGATCTAGTCATAAGATAAACCGGGAGACC<br>GGCGATATACTTAAATACTTTGCATACACCATATGTCTCGACTCCAGTGGCCTCAAAGGCCCTTGAGGTGCTGGCCGACAGGA<br>GAGCGAGGTGAGCTACCTTGAGAAGCTTACTGCCAATCTGGTCGCCATACTGAAGGAACAAAAGACCAATTACGGCACCTGTGTGC<br>TGCACCTGCCCTTCAAGATTAAGAAAAAGAGGTAGCCGCCATTAGTGATGCCATAAAACAAATCAACGACATCGAGCTGGTGGTG<br>GTAAAGATCAATGTGGATAACAAGTATTTCGGATACTCCTTCCACACACATTGGTGCCCTACGAGAGCAGCTTCGTGAAGCTTTC<br>TAAGGATGAGTATCTGGTGTGGTTCAGAGGGCCTGCTGTACGGCAAAGAGATCGTAGATAAGAGGTTGAGCAACCCCGTGCACATCC<br>AATTCTTGAACATCACCAACAGGAAGAACTTCGATGAGCAGGCGTTTCTGCAGGACATTCTGAATTTGAGCGGAGCCAACTGGAGG<br>GGCTTCAACGCCAAAAGCATCCCTATCTCAATTTACTATTCTCAAATCATCGCGAGGTACACCGAGGCCTTCGAAAACATCGACGG<br>TTACAAGGAGGGTACTATCTCTAACGACAAACCCTGGTTCCTGTAGTAA |
| 85 | ATGCCGAAGAAAAGCGAAAGTGGAAGACCCCAAAAAGAAGCGGAAGGTGGGCAGCGGCAGCATGGACAATTTGGCTCTCTCTGC<br>GCTTCAGCTGGACAGTAGATTGGATCACTGTATGGTATATCAATACAGGATCGTGTACCATAAGTTCGACGAAACAGAGGCGGGTG<br>AAAAACTGGCAAGAAAGGCCGCCTACGAACTGTGGAAGGTAAACAACTTCGGACTGCTCACCAACCTGGGTGCCAGTAGCATCCTG<br>TCCCTTAAGAGCCTGAGTCAGCTGTCTATCGATTCACCGCTGTTGCAGGCAAGTTTGAAAGCTGACGGCCAGTTGGAGCTGGATTG<br>CGGTAACGAACAGCATCAGGAGGCGCTGCAGAGACTCGTGAACCAGGACATAAACAAAGCGGCTTGGAACCTCAAACAAGCGAGCG<br>AGGGGAAGCTTGATTGCCGAAAATCACCAGGCGGGCACGCCGAAATCTTCGAGCCAAGTCACAGTAGTCGGATCAAGGCCCACAGT<br>ACCTATTTGGATGCCTTCTGCACCGTAAGGCTGATTCCCGAAGTGCTGTCAGACGGGACAGTGCTGATAGGGTTGCATCTTAAGCA<br>CAGCCTGACCGCGAAGGCGGACATCTCTCTTCAGTGGGTCATTGATCATAGGCCCGATTGGCTGATATCCATAGAGAAGGTGCGCC<br>ACAGGTATTACGAGCCCGGCAAGGCACCCCTCGTTGCGGAGTTCGTGAAAGTCGATGATTCCATCAACGGATCATCCCTTCTCCCA<br>CACTTGGGCAAATCCCTTGTCGCTTACCACCAGGAGAAAGGGCTGCTTTCAGCCGGACAGCTCGCAGGGCAGCCACCAGCTCACT<br>CATCAAAGTGCGCTACGGACAGAAGGAGGCAGACCACGTTGCTAGCTTGGTGGAACCCATGTTTGATTTCGATACTCTGTCAAAGA<br>TTGACAGCCCCTTCCTGAATAGGCTCGCCAAAGACCTGAAGTGGAGCTTGGACGATAGAATAAAGACAAGCGCGGAGATGGTCAAG<br>AGGCTCTACCTGCCCGGGTTTAATCGAAAGTTGGTACAAGTTGACTACCAGAATCTGAGCAGGAAGAGGTTCAACCACAACCTTAT<br>GCTCCAGTTCGCGGATGGGCAAGGAGCGGCCATGAACAAGACGTCCTGAAATACAAGGCTTTCGCCGACATGACCAGGGCTAGGG |

TABLE 17-continued

Argonaute nucleotide sequences containing 2X Nuclear localization sequence (NLS) from Simian Vacuolating Virus 40

| SEQ ID NO | Sequence |
|---|---|
| | TAATCCCACTCGTGGTAGGAGAGAGGAACAACACCGAAAGCAATAGACAATTGCTCCGGAACGCCTATAACGCACTGAGGCAACTT<br>ACCAAGGCCGAATTGCCCCCCTTCACGTCATTTCCCCCCAGCATCGGAAACGCCGACGAGTTGGACGCACGGCTGCACAAGAAATG<br>TCCCGACAACGCCATCCTGCTTATCGGGCTCACAGAGAAGAGTGACAAAGCCGCGATCAGGGACACGCCGTTCAACTACGGCCTGG<br>CCACCCACTTCATGACGCTCGATCACAACCCCAACGTTTACCACACCTTCTACTTCAATAACGTCGCAGCGGCCCTGTTCTCCAAC<br>GCAGGAGCGCAACTGTGCGCCGTGAACGACATGCCCGGTGAGACTGAACTGTTTATCGGTCTGGACATGCGCCGCGTCAATGTAAG<br>GGCCCCACCTTTCGCATTCCTGTTTCTCAACTCTGCCGCGCAACTGGGCTGCCACCTGGCTCACAAGCAGCACCGCGACAAAATGC<br>AGGACGACGCrCTCAGCAATCTGCTCGAGAAGTCTCTCAAAACCTACCTGAGGAGCACCGACGGGCTTTTGCCAAGGAGGATAACT<br>CTCCACAGGGACGGCAGGTTTTACGAGAGCATCAATGTGATAGAACAGTTTGAGCAGAAGCACGGGGTCAAGCTCGATGTTCTGGA<br>AGTCTTGAAAAGCGGAGCCCCGGTGCTGTACCGGAGAGAACGCAGTGCGGACGGTAAGAAAGTTTTCAGCAACCCAGCGGTTGGCG<br>ATGCCGTCTTCCTTAGCGACAGGGACGTCATTCTTAGCACTTACAGCGGCGAGGAACTTGGGAAGTCATGGGCTAACAAGCTGAGT<br>GTGAGGCCACTTCGACTCCGAAAGAGATACGGCGAGACCGCATTGAGCGTGTTGGCCCATCAGGTGTTGGTCCTGTCTAGGATCCA<br>TGGGGCCAGCCTCTACCGACACCCCCGACTTCCGGTGACCACCCACCACGCGGACAGGTTCGCAACCTTGCGGCAAGATGCGTGCA<br>TAGACGCACTTAGTAAGATGGATAGACTGTGTCCGGTGTATCTGTAGTAA |
| 86 | ATGCCTAAGAAGAAGAGGAAAGTGGAGGATCCCAAAAACAAACGAAAGGTCGGCAGCGGTTCTATGAGCGAGCTGGAGACCAACAT<br>CTTCCCCAATCACCAACTTGCATGAGCTTGAAAGCAGGTTCAGGTTGTATAGGGTGAGGGGCCTGAGCATCAACCAAGAGGAGTACG<br>ACCCCAACACCCAGACATTGGTGAGGAAGCTGAGCTACAGCATGAGGTCTCCCGTAGCTGTGATACTTAGGAACAGCGACCCGTTC<br>CTGGGCTCTTCCAATCGACGCACCCGAGCCCATCTCTCCGTACCCGCTCGTGAGAGCCACTGCTGTGTTCGAGAAGACGGACGAGGT<br>ATTTACTCTCGATTACGAAAGCCCAACTCCCGAGACAGATGCGCTGCGAATAAGGTTCCTGCAATTTATCATCCAAGGCGCGCTGT<br>TTAGGAATCCCAGCCTGTGGCAGCCCTCAGCTGGCACCCCCTTCTTCGAGAGGAGCCCCGTGTTGGAGAAGGCCGGCATTTGCGCG<br>TACCGAGGCTTCTCAGTGCGAGTCGTGCCCATAGAAGGTGGTAAACTGGGAATCTGTGTGGACGTTAAGCACAGGTACGTCAGCAA<br>AAACCCCATCGAAGCAAACATCAAGCGCGAGGAATTCAGGAAATACAAGAACGGCAGGTGCATATACCACTACGGCCACAACTGGT<br>ACGAGATCAAGTTGCAAGACCACACTGGGCTGTCCGTGTCAGAGCAGATGATCAGCAACGGGACGGCCAAACCCATAAGCTTGTAT<br>CAGTTCATTATGAATAACGCGCCCAAGCCCCTGCCCAGGGAGGTCATAGACATGCCTCCCGACTCACCCGCAGTCAAATACATGAC<br>CAGCAGGGATGAGGTGCGCTACGTGCCCTCCATCCTTTGTTATCCGGTCTTTGACACCTCTGACCCCAGGGTGAAGCCGACGCATA<br>GGGGCACAATCCTCCTCCCTAACGTGAGGCGACAGTATATCCACAATTTCGTGAACTCACACCTGACCGATGTGCGATCCAAAGAC<br>ATGGCAATCCGAATCAGCAGCAAGCCAGTTATCGCCCCTACCAAGATTTTCCTGCCGCCTGACCTGGCATTCGGCAACAACACCGT<br>GTTCAGCGTAAGAGGCACACCCGGGACCACGTATGTTAGCCTGGAGCAGCTGGGCCAGACGCGGATAAGCGCCCTCTTCAATCAGA<br>AAATACGCCCTTATCACACCAGGCCCCTCGATACGCACTACATCATTCTCCCCAAAACCCTGTGCCACTCCCACGCGCCACTATTT<br>CTGAATGACTTTAAGAAAATCATGAACGAGCTGTACCTGCACGAACTGCCCTACAATCCCATCGTCGTGACCTACAACGACTTGAG<br>CGCCAAGACCTACGCCCTTCAGCCAAGGGCTATTCTGGACGCCGTGCACAGCCAACTCAGACAGCCGCGATACGGCGTGGTTATGA<br>TACACGAGACGGTGGACCGCCGGAATAGACAGCACGACCAGCTTGCCGCGATGGTGATGAGGGAGCTCCGGAACAGGAGGCTCTAT<br>GTCAGCGTCATCCATACCACCCTGACCAAGCACTGTTACCAATTGCCCCACAACCCCCCATTGCCAAGGCCTACTGCCCGGTAGC<br>AGCCAACCAGGGCAAACTCAATGGCTACTTCAGCAACGTCGCCATTACCAACGTCCTTCTGACCAACGAGAGCTGGCCCTTCCTTA<br>TATCTACCCCGCTGCATCCCCACTTTACCGTTCCCTTCGACGTTCCACCTTAACACCGCTTGCTTCACATTCATCGGCAAGAGCGCC<br>TCCGACATCCGGACCGTTTTCAAGACCAGTAACCAAAAGGAGAGGTTGAGCAAGCCACAAGTAAGGCAGACGCTCCTCGAAGTGCT<br>CCGCCAGGAGGTTGGCTTCGGTCGACGGACCATGCAGACCATAGTGGTTCAGAGGGATGGCAAATTGTTTGCCAGTGAGATCGCGG<br>GAGCAAAAGACGCTATAGAGATAGTGAAGAAAGAAGGCATCTTGCCCAGCGATGTGTCACTGAATTTCATCGAAATCCCCAAGAGC<br>AGCGTCGCCCATTTAGGCTGTTCGATAGCAGCCCCAGGCCAGGGCAGCCTGAAATGGCGAACAACCCAAGAATCGGCTCCTACTT<br>CATCGCGACGAATTACGACGGTTACATTTGCACCACCGGCAAGGAGTTTTACCATCCCGGTACGGCAAATCCTCTCCACGTGAAGT<br>ACATCGAGGGAAATATGCCATTTGAGAAGATCCTGGAGGACGTGTACGCCTTGACTTGCTTGGCGTTGACCAGGCCCGAAGACTGC<br>ACAAGGGAACCCTTCACCATGAAACTGGCCGATATCCGACTGAGGGAACATGCCGGAGGCTACGACGAAGATGCATTGGCGTATGA<br>TGATGAAAATGAGAACGACGAGGATAACGAGAATGAATAGTAA |
| 87 | ATGCCGAAAAAAAAGCGCAAGGTGGAGGATCCAAAAAAGAAACGGAAAGTGGGATCTGGCTCCATGAACTACACAGAGGCCAAGAC<br>CGCCAATAGCCCCTTGTTCCTTAGCGAGATTAGTAGTTTGACACTTAAGAATAGCTGCCTGAATTGTTTTAAGCTGAACCATCAGG<br>TCACCCGGAAAATAGGCAACAGGTTCTCTTGGCAGTTCAGCCACAAGTTCCCTGACGTCGTGGTAGTGTTCGAGGACAATTGCTTT<br>TGGGTGCTGGCTAAAGATGAAAAGAGTTTGCCTAGTCCACAGCAGTGGAAGGAAGCACTGTCAGACATACAGGAAGTGCTGAGGGA<br>AGACATTGGGGACCACTACTACAGCATTCACTGGTTGAAAGACTTCCAGATAACCGCCTGGTCACCGCGCAGCTGGCTGTGCGGA<br>TTTTGAAGATATTTGGGAAGTTTAGCTACCGATCGTGTTCCCCAAGACAGTCAGATCTCTGAAAACCAGGTGCAGGTGCGAAGG<br>GAAGTGGATTTCTGGGCTGAGATAATCAACGACACGGACCCAGCAATATGCCTGACGGTGGAAAGCAGCATCGTTTACTCTGGCGA<br>CTTGGAACAGTTTTACGAAAATCATCCGTACCGACAGGACGCCGTGAAACTTCTCGTAGGGCTGAAAGTGAAAACTATCGAAACCA<br>ACGGCATCGCGAAGATTATCAAAATTGCCGGGACCATCGGAGAAAAGCGGGAGGAACTGCTGACCAAGGCAACCGGGTCCATAAGC<br>AGGCGCAAATTGGAGGAGGCACACCTGGGCCAACCTGTGGTGGCCGTGCAGTTCGGCAAGAATCCGAGAGAATACATCTATCCCCT<br>TGCCCGCGCTCAAACCGTGTATGACCGACAAAGACGAGAGCCTGTTTCAAGTGAACTATGGCGAGCTTCTGAAGAAGACTAAGATTT<br>TCTACGCCGAACGGCAGGAGTTGCTGAAATTGTATAAACAGGAGGCGCAGAAGACGCTGAACAACTTCGGCTTCCAGCTCCGGGAG<br>CGGTCAATCAATAGCAGGGAGAACCCCGACTTTTTCTGGACCCCCTCAATTTCCCTTGAACAAACGCCCATCTTGTTTGGCAAAGG<br>TGAGCGACCTGACAAACCACACACCTTCAAACCCTTCACCAAACCCCGCCTCTACAACACACATAGCCACTACGTCCACCCCCCCA<br>GAAAGATTAGGCTGGCCATCCTGAAGCCGGCCAATCTCAAGGTTGGCGATTTTAGGGAGCAGCTCGAGAAGCGACTGAAGCTCTAT<br>AAGTTCGAGACCATCCTTCCCCCCGAGAATCAATCAATTTTAGCGTACAGGGCGTGGGCTATCAAAAACGACCCCGCTTGCAAGA<br>GGCCGTGGACCAACTCATTACGGGGCAGATACCCGTGGATATCGCTCTTGTCTTTCCGCAGGAGCACCGAAACGCCGACAACA<br>CCCAGGAGGGGAGCCTTTACTCATGGATCAAGAAGAAGTTCCTTGACAGGGTTGTGATAACGCAAATGATCTATGAGAAAACGCTT<br>AACTATAAGAACAATTACAAGAACATCCTCGATCAGGTGGTGCCTGGAATCCTTGCGAAACTTGGTAATCTGCCTTACGTGCTCGC<br>AGAGCCACTGCAAATCGCCGACTACTTCATTGGCCTGGATGTGGGTCGCATGCCTAAGAAAAACCTCCCGGGTCACTTAACGTGT<br>GCGCGTCCGTAAGGTTGTACGGGAAGCAGGGCGAGTTTGTGCGGTCAGGTCGAAGATAGTCTCACCGAAGGTGAAGAGATCCC<br>CAGAGAATCCTGGAGAATTGTCTGCCCCAAGCCGAGTTGAAGAACCAGACCGTGCTGATATACAGGGACGGTAAGTTCCAGGGCAA<br>GGAGGTGGATAACTTGCTGGCCCGAGCCAGGGCCATTAAGAGCAAATTCATACTTGTCGAATGCTATAAAACGGGCATCCCCAGAC<br>TGTATAACTTCAAGCAAAAACAGATCGACGCGCCCAGTAAGGGCCTGGCGTTCGCTCTGAGTAACAGGGAGGTGATCCTGATCACG<br>TCCCAGGTTAGCGAAAAGATCGGCGTGCCGCGACCTCTGAGGCTTAAGGTACATGAGCTGGGAGAGCAGGTAAATCTGAAGCAACT<br>GGTGGACACCACACTCAAGCTGACCCTGCTCCACTATGGGTCTCTTAAGGACCCGAGGCTGCCCATCCCCCTTTACGGCGCTGACA<br>TCATCGCGTATAGGAGGTTGCAGGGAATATATCCCTCTTGCTGGAGGACGATTGTCAGTTCGGCTGTAGTAA |

TABLE 17-continued

Argonaute nucleotide sequences containing 2X Nuclear localization sequence (NLS) from Simian Vacuolating Virus 40

| SEQ ID NO | Sequence |
|---|---|
| 88 | ATGCCAAAGAAAAAAGGAAAGTCGAGGACCCCAAAAAGAAGCGAAAAGTGGGCAGCGGCTCCTTGGACAATTACATACTGACCGA<br>GTACAAGGCCGGCATCCACGCCAGCGAGATCAAGATACACATCTACCGGATGCCCGTCAAGGATCTTGAGAAAATCGACTATGAGT<br>ACGGGAAGTACACACGCGACCTCAGACAAAAAAACAGGAAGACGATATCCTTTTACCGCTCTCTGATCGGCAGCTTTGAGAAGCTC<br>ACCATCGTGCCCAAGGGATACGAGAAGTACGAGTATAGATCAATTAAACTCGACCAGAGTGAGGAGrCACTCCAGGAGAGGAAACT<br>GCTGGAGAGGCTGATCTTCGACGGCCTTAGGGACAGCAATAGGAACCACTTTATGAGCACCGAGCAGAGCATCATCGAGAAAGAGC<br>CCATCAAGTCCCTGAGCAAGTGCAAAATCCACCGGGGTATCTACATAGACATCACCGTGAAAGAGAAAGGCGACATCTTCATCGGT<br>TTCGAGCTGAAGCACTCCATCCAGAGCACCCACACGATTATCAAGGCTCTGAAGGAGAAGAAACTGAACAAGGGCGATAAGGTGTT<br>TGACTTTCTGAACAGCGCCCACTACGAGTTCGAGGGGATTAGCGACAAAACCATCAGCGACCCCCTTCCCGAACTGGGCAACAAGA<br>GCATTATCCAGCACTACAAAACGAAACCCAGCATCTACTGCCACCTCGTGAAAAAACCGAACATGCCCGCCATCCTGGTACGCAGC<br>AAGAGCGGCAAGGTGTATCCTTACCCCCCACAGCTGCTTAAGAAGGAGTGCCTGATGAAGGATGTGCCGGCTAAGGAGCACAGCTC<br>TATCAAGCTGAACCCCAACGATAAGATCAACTACAGCATTGAGATCATGAAGAGAATCATAGATGCGTTCGAGAACAGGTATTCC<br>CCATCGGCTTTGAAAAGAACAACCTGAACATCGCCAAGCTCGGATACAGGAGGAGGCTGGTCCCGGATCCCCTGCTGAGGATTGGC<br>AACGGAGCCACCTGCAACCACAGAGACCTCAAGGGTGCCTTCCTTAGGCACAAGATTTATGACAGCGTGAGCTCCCCTATCTACTA<br>CCAGCTTCTGCTTGACCAACCCTTCGAAAGGGAGTGGCAGAAAAGATGAGCGAAGCGTTCATTACGAAGATGGAAAACCGGAGCA<br>GGCAGTGGGGCATAAAGCTTCAGTGTACCGGGAACCAGATCCTCCCTACCTCTAACCCGTACGCGCTGAGACTGCATCTTAAGGAC<br>ATCAACCTGGATACCGACATCATTAGCGTGGTCCTGTTGGACGAGACCAAACAAGAAGGCGAGGAGGTTTACTCTACCATCAAAAA<br>AGAGCTGGGTGGCACCAGGGGCGCACATACCCAGGTAATCCTGATCGATAGCCTGAAGAACGAATACACTATCCCCCAGATACTGT<br>TGGGAATCTACACCAAGGCTGGATTGCAGCCCTGGGTCTTGCACCAGCCGTTGCACGCCGACTGCTACGTTGGCTACGACGTGAGC<br>CATGAAAATGGCAGGCACACCACTGGCATAGTGCAAGTGTTCGGCAAAGACGGGTCACAGATCTTCAGTCAGCCCATTAGCAGCGC<br>GGAGGCCGGAGAGAAGGTGTCAAAGGAGACCATTCAGACTATGGTGATACACGTTCTTTACTATTACCAGAAGAAAGTTGGCAAGA<br>TGCCACAGCACATTGTCTTCCACAGGGACGGCCGAGGATACGTAGAGGAGATAGACTGGATTAAAGACATATTGAGTAATAGGGAC<br>CTCACCAACGGCCAAAGCATCGCTTTCGATTACATCTCAGTGATCAAGAGTGTGGTCGGCGCATGGCTTACTTTGACGACATAAA<br>GAAGAAGTATGTGAACGTGCCCGGGATTGCCTACCTGGACGACAACGCCCAAAAGGCCTATCTTTGCAGCACCAATCCATACGAAA<br>AAGTAGGGATGAGCAAACCTATTAAGATTGTGAAGAAGATTGGCGAGATGACCCTGGAGCAGATCGTAGAAGACATCTATCACCTG<br>AGTTTTATGAATATCGACACCGATAGGAAGGTGAGGCTGCCCGTGACTACCAATTACGCCGATAAGTCTTCAACGTTTTTCTCTCG<br>CGGCTATCTGTCATCACAAAAGAAAGGAATTGGCTTCGTATAGTAA |
| 89 | ATGCCGAAAAAGAAAAGGAAAGTGGAGGACCCCAAAAAAAAGCGGAAGGTCGGGAGTGGCTCCGTGGCCGCTTTGAAGCGCTACTT<br>TAATGACAAGAACCTGATCGTGATAGGCTACTCTGGCAGGGACAAGAGCCTGATGAGTGCGCTTACCGAGGCTTTCTCTGAGAAGG<br>GCTCTGGCCGCATCTACTGGTGCGGCTACGGCAGCCACATTTCCCCGAGGTGGAAAGCTTGTTGAGGACCGCGCGAGAGGCAAAC<br>CGCGACGCCTACTATATCGACACCGATGGGTTCGACAAAACCATGTTCAGCCTGGTAATAAACTGCTTCCAGGCGGATATCGAAAA<br>GAAGAAAGAGATAATGAGCATCCTGGAGTCTGCTCCCGAGGACAACGATACCAGCCCGTTCTCAATTCACATCACCAGGACGGATA<br>AATACCTTAAGTCCAACCTCTACCCGATCATCTTTCCTAAGGAGCTGTTTCAGTTTGAGATAGAATATCATGAGGGCGAACGACCA<br>TGGACCCTGCTGAGAGAGATCACCAAAGACCAGAACATCATCGCCGTGCCCTACAAGCAAAAAGTCTACGCCTTGTCAACGGGATC<br>AGCTATCAACAACGTGTTTGGTAGCCGGTTGAAATCAGATATAGAGGAGGATTCCCGTGCTATGGATGACATTGAGCGCAAGTCTA<br>GTTACAGGGAGCTCTTCCTGGAGGGCCACCCTTCAGTCTATAGCATTATAAGGGGCCTGAACGTGGACATACGACACAATACCCTT<br>TGGCGGAGCGACATCTTTAGGAACGACAATGGCACCCTCATCCACGAAGCGATCGAGTGTTCCCTGGTGTTTGTGCCCCAACAGAA<br>GTATGCCCTGTTGAGCTTGAGGCCCACCATCTACATAGAGAACTCTCATACGGTTAGCAAGGAGAAAAAGCAGGAGTACGCCAGGA<br>TCTACCTGGATAAGATGTGGAATAAAGCGTACAGCACGAAGTTGGCCCAGTGGGAATCTATAATCTTTGGAGACACGAGGCTCGCC<br>TTCGAGGTGCCGCAAAATTCAGGATCCGGGTTTAAGTTTCTGATAAGCCACAACTGCGGCTTCAGCGAAATCCAGTATCAAGCAA<br>CACCGAAGGGGATACAGTAGCAAGAGCTACGACAACAAGAGGACGATCTATAGGGGCTTGCAGCTGAAGGAACCCGAGCTGGAAT<br>TTGTCAATACGTTTGCAGACCGGCCCTTCCTGGACAGCAACCCCATGCGAGGCCTGAGCAATCACAGGCCGTACGACAGCTGGCAG<br>AAAGACGTTCTCTTGCAGAACGTGCGGTTGGGCGTGATTTGCCCGAACACGCACCGACCGATTCCACTCTTTTCTGCAGCAGCT<br>TAACACCACAATTCAAGCCAATGACGATAGCGACTACATTCAGTCCTACACCGGTTTCCATAGCATTTACAAGACTCTGCTGGAAA<br>TCCCCGATAACGGGACCGACAAATGGATAAACATCGAGGATACCCCCAAGGACACCATCAGTCTGGTTCAGAGTATATGTCACCAA<br>GCGAACCGACTGGCCGACAAGTACCCGGGCATCGTGGTGGTGATTTTCATCCCCGCATTTTGGTCTATCCATCGACAGTTCAAACA<br>CAACGGGGAGAGCTTCAGTTTGCACAACTACATCAAGGCCTACGCCGCACAATAGCTTCACTACCCAAATCATTGAGGAAAAGA<br>CGCTGCGCGACCACATGGTCTGCGAAATTTGTTGGTGGCTGTCACTCGCACTGTTCGTTAAGGCTATGCGAATCCCGTGGGCACTG<br>GCCAATTTGGACTCTGACACCGCTTACGCGGGTATAGGGTACTCAGTGAAGACCAACAGCAAAGGCAACGTCGACATAGTGCTTGG<br>ATGTTCACATATATACAACGCAAAGGGCCAGGGTCTCAGATACAAACTCTCTAAGGTCGAGCAGCCCCAATTCGATGGCAAGAAAA<br>ATCCTTACCTTACGTATGAAGAGGCCTTCAAGTTTGAATTACCATCGCGAGTTGTTCGTCAAAAGTATGGACCGGCTTCCCAGG<br>AGGGTTGTGATTCACAAGCGGACGCCGTTCAAAAAGGAGGAAATAGAGGGAATCACTCACGCGTTGACTCAGGCTGGCATTAAGGA<br>CATCGATCTCATTACGATCAATTACGAGTACGACGCCAAGTTCATAGCGCAGAAGGTATACTATGACAACATCAGCGACGATTCAT<br>ATCCCGTAAGTAGGGGCACCTGCATCAAATTGTCCAGCCGAAATGCGCTGCTGTGGACACACGGCGTGGTTCCCTCAATCCGGGAG<br>AGACGACGCTACTACCCCGGTGGGCGCTGTATTCCCGCACCCCTGAAGATAACAAAATACTACGGTAAAGGCGATCTTCCGACAAT<br>CGCCAGCGAGATTATTGGATTTACTAAGATGAATTGGAACAGTTTTAATCTGTACACGAAACTGCCCGCCACCATAGATACGAGCA<br>ATACATTGGCGCAGGTCGGCAATCTGTTGCATCAGTATAACGGCGAACTTACGACTACCGATATTTCATCTAGTAA |
| 90 | ATGCCCAAGAAAAAAGAAAGGTGGAAGACCCTAAGAAGAAGCGCAAAGTGGGATCCGGCTCTATGTTGGAGACGAATATCAGGGT<br>GGTGCGGCCTGGTCCGCAGCTGTGCGTTCCTGTACGCAGGGTGATCGTGCCGGTCAAACCTTGGCTCCCGACCTCCTGGAGAGGC<br>TGTGTAACCTGCTGCGAAGGAGGTACGGCATTAGCGCCGCAAGAATACCGGGCTCCGTGAGCGAGCTGTTCGTTGGCGACCGACCGG<br>CAGGTGGAGAAGGTGACACTGGAAGAAGATAACTGGCAACTGACCGCCGTGGACTCCAACGACCCTACTCGAATCATGTCCATCTC<br>TAACACGGACGATGAGAGCTTTATAAGCATCCTGATCGAACGCGCGCTCCTTGCCCAGATCGCCAGTCGAAGCCTCTTTTGGACCC<br>TCGACTCTCCTCGAATTTGGTATGAGAAGAACCCGTTCCAAAGGAATGAAGGCGTAGCCGTCTACCACAGGTACGAGGTGGATGCG<br>CTCCCCCTCGGCGACGCAGGCATTGGCATCTCAGTGGATGTTTCAACGGCCTTTTTTAGCGAGCACACCCTGGAGTACTACTTCGC<br>CCCCAACCTGATTAGCGGCGAGAGCAAGACGCGACAGGACGAATTCCACAAGTTCACCGGCCGACAAGCTGGTCAAAAGGGGACGC<br>TGCTTTACAATAACGGCAGGAGTAAGGTGAAGTGCTATTTCGAGAACAATAGGGTGGGCCTGACATGTGGCGCAACCGGCCAAATG<br>AAACTCGAGGGAATCACGTATCCCAGCCTGTACCACTACTATGCGAGCAAGTATAGCGCATTGCAGATCAACGAGAACGATGCCGC<br>AGTGCAAGTGTCTTTCCCTGGCTTGGACCGCCCAGTTCCGGTAGCCGCCAGGCTCCTGTCCCTCCGAGTGATGAACGACGACGTGC<br>CCGATGGTCTGAGCTCCGTCGACAAGATCCCTCCAAGGAACCGCAAGTACCTTATCGAGCAGTTTTGGAAGTGCCTGGAGCCGAGA<br>CCCTTCGGGAATGTGGCCCCTGGTGTCTTCGACGGCTTCTGGAGACCCAACAACGAAAGGGTGCATTACATCCAGCTGCCCGAGAT<br>TAACTTTGGACAAGGCCAAAAAGCAGAACCGCCTGACGTACGCTCCGTTGCATCCATCAAAAACTATTTTAGGCGACGACTGGAAT<br>TGCTGGGTCACGCGGGGTGTTACCACTTTCCGCCCTCAGCCCCCAGGACAATCTTCTGCGCCTACCCGCAGTCATTGGGTGAGGAG |

TABLE 17-continued

Argonaute nucleotide sequences containing 2X Nuclear localization sequence (NLS) from Simian Vacuolating Virus 40

| SEQ ID NO | Sequence |
|---|---|
|  | ATCCCGGAAAAGTTGGTGAACGGGATCGTCAATGTGCTGAACAAGTGGACCGGCCTCAGCTTCTGTAGCAACCTGGTAAGCTACAG<br>CACGGCCAGCGAGGCGTACGGTAAATTGAGGAGGGCCGAGAGTGCCGGCGTGGTCCTGTTCATCTTGGACGAGGAGCCGGCAGTCT<br>ACTACGACGCGAGCTTCAATCTTGAGGGCTGGAGGGTAAAGCGCGTAACCGAGCCTGTGCTGCGCCAGCAGCATAAGTATCTGACC<br>AACGGCGTGTGGGACCGGAAGAGGCAAGAGTATAGTTTGGGGAGGGGGCAGAGTCGCTGGGAAAGCTTCATCAATTTGATCGGATT<br>GGACGTTATCCAGCAACTCGATGCCATTCCGTATAGGATCCCCAACATCGGCCCTACGAAGGCCAGCTGATAATCGACGTGGGGC<br>ATGACAGGCAATTCTTCGCCGTGTCACTGCTTATTGTGAGATCAGAAGACAAAGTGCCCGCATTTAACATCAGCAGCCAGGTCCAG<br>CACAAGGCGGATCATAAGCACGAAAGCATTAACCCGGTGCTGTTGAAGGACACCATCATTAACGTGTTCAAGACCGCCAAACGGAG<br>GACTTTTGATCCTCTGACTAGCCTGTTGATCATGCGGGATGGCAACGTGCAGGGCAGCGAGATCGGCGGGATAGACAACGCCCTGG<br>TCGAACTTAGGCAACTTGGCATAATCTCCCCCGATGCGAGGCTGGACATCGTGGGCGTACACAAGGAATCTGTAAGCTCCATCAGG<br>CTCTGGGACGTTGACGTAAGGGGGGAGGTAAGCAACCCGATCGAGGGCACCGGTCTGTCAGTCAACTCATCTCTGTACCTGGTGGC<br>GTGCACAGGTGAGGCCACGCTGACCCAAGGCACCGCAGAGCCCGTGGCCATCGTCGCAAACAACAGGTGCCTGAGTATTGCCGATG<br>CAGCCCTGAGCGCCTTTCTGGCAGCCCAACTGAACTGGAGCAGCCCGGGAGTCGCCCAGCGCCTGCCCCTGCCTCTGAAAAGAACA<br>GATGAGGAACTTACCGCTAGGAGCGATCAAGAAATTAGGAGGATAAGGTAGTAA |
| 91 | ATGCCAAAGAAGAAACGAAAGTGGAAGATCCCAAGAAAAAAGGAAAGTTGGTAGCGGCAGTATGATAATGAGCCTGGAGAGCAA<br>TATCTTCACTTTTAGCAACCTCGGGACACTTACCACGCAGTACCGACTGTATGAGATCAGAGGCCTGCAGAAAAGGCACCAAGAGT<br>ACTACCAGAACAGGCAAATCCTGATCCACCGACTCTCCTACCTTCTGAAAAATGCCGTAACTATCATAGAGCGCGACGAGAAACTG<br>TACCTTGTTGTAGCTGCCGATGCCCCGGAACCACCCAATAGTTATCCCATCGTTAGGGGCGTCATCTACTTCAAGCCCACCGGCCA<br>GATTCTGACCCTGGACTACAGCCTCCGAACACCCCAGAACGAAGAGATCTGCCAGAGGTTCCTCCATTTCATGGTACAAAGTGCCC<br>TGTTTCAAAACGCGAATTTGTGGCAACCCAGCGCCGGAAAGGCTTTCTTCGAGAAAAAGCCCTCATTCGAGTTCGGATCAATTCTG<br>TTGTTTCAGGGATTTAGCGTTAGGCCCATATTCACCAAGGACAAGATCGGCCTGTGTGTAGACATCCACCATAAATTCGTCAGCAA<br>AGAACCCCTCCCTAGCTACCTGAACTTCAACGAGTTCCAAAAATACAGAGGCGTGTCATGCATCTACCATTTCGGCCACCAGTGGT<br>ACGAGATCCAACTCTCTGAACTCTCCGAGCTTAACGCGACGGAGGCAATGGTACCCATCGAGAATAAGTTCGTGACCCTTATTAAC<br>TACATCACCCAGCAAGCCAGGAAGCCCATCCCGGAAGAGCTGGCAAACATGTCACAGGACGCAGCCGTCGTGCACTACTTTAACAA<br>TCAGAACCAGGACAGGATGGCGGTGACGAGTCTGTGCTATCAGGTTTACGACAACTCTTATCCAGAAATCCGAAAGTACCACCAGC<br>ACACCATTCTGAAGCCACACATCCGCCGCAGCGCGATCCACGGAATAGTGCAGAAGTATCTCGCGGAGCTCAGGTTCGGCGACATA<br>ACCCTGAAGGTATCAACTATCCCCGAGCTGGTGCCCCAGGAGATGTTCAACCTGCCCGACTATTGCTTCGGCAACGATTACAAACT<br>GAGCGTGAAAGGAAGCGAGGGCACAGCCCAGATTAGCCTCGACCAGGTCGGGAAGCAGCGCCTTGAGCTGCTGAGTAAGGCTGAAG<br>CTGGTATCTACGTGCAGGAAAAGTTCGACCGCCAATACATTCTCCTGCCCCAAACCGTGGGGGACAGCTTCGGGAGCCGGTTCATC<br>GACGACCTCAAGAAGACCGTGGACAAGCTGTACCCCGCTGGAGGAGGGTACGACCCGAAGATCATTTACTACCCCGACCGAGGTCT<br>CCGGACCTACATCGAGCAGGGTAGGGCTATACTGAAAACAGTTGAAGAGAACGAGCTGCAGCCCGGCTACGGTATCGTAATGCTTC<br>ATGACAGTCCGGATCGACTGCTCAGACAACACGACAAACTCGCAGCTCTGGTCATTAGGGAGCTGAAGGACTACGATCTGTACGTG<br>GCCGTCATCCACAGCAAGACCGGGAGGGAGTGCTATGAGTTGAGATATAACAACCAGGGCGAGCCCTTCTATGCAGTAATACATGA<br>AAAACGGGGGAAGCTCTACGGCTACATGAGGGGTGGCGCTCAATAAGGTGCTTCTCACCAACGAGAGGTGGCCCTTTGTGCTTT<br>CTACCCCCTGAATGCGGACGTGGTGATCGGAATCGACGTCAAGCACCACACCGCCGGTTACATAGTCGTCAACAAGAACGGGAGC<br>AGGATCTGGACTCTGCCCACGATCACGAGCAAGCAGAAGGAGAGGCTGCCCAGTATCCAAATAAAGGCGAGCTTGATCGAGATCAT<br>CACTAAGGAGGCCGAGCAAACAGTAGATCAGCTGCAACAACATAGTGATACATAGGGACGGACGAATACACGAAAGCGAGATCGAGG<br>GCGCCAAGCAGGCGATGGCCGAGTTGATTAGCAGGTGTACGCTGCCTGTGAACGCCACACTCACGATCCTGGAAGTGGCGAAGAGC<br>AGCCCCGTTAGCTTTAGGCTGTTTGATGTCTCCAATACCAATTCTAAGGACCCGTTTGTGCAAAACCCACAAGTCGGGTGCTACTA<br>CATTGCCAACAGCACTGACGCCTACCTGTGTAGCACGGGGAGGGCGTTTCTCAAGTTTGGCACCGTGAACCCCCTGCACATAAGGT<br>ATGTGGAAGGTACGCTCCCCCTTAAACTGTGTTTGGAAGACGTGTACTATCTGACAGCCCTGCCTTGGACGAAACCCGACGGGTGC<br>ATCAGGTACCCCATTACCGTAAAGATCAACGACAGGAGGCTTGGGGAGGACGCCAGTGAGTACGACGAAGACGCCCTGCGCTTCGA<br>GCTGTTCGAGTCTCTCGAGTCCGAGGATGACTTTGACGAGATGACCGACAGCGACTTTAATCAGGAGGAGACAATGGTGTAGTAA |
| 92 | ATGCCTAAGAAAAAAGAAAAGTCGAGGATCCCAAGAAGAAGCGGAAGGTGGGGTCCGGGTCTATGCTCACACAAGAACAATTTAT<br>ACGCAACTTTAGCGTTATGGCCAATGGTGAAGTAGACTTCTTTCTTGGTGCCGGTGCATCTATTGCGAGTGGAATCCCAACTGGGG<br>GTGGCTTGATTTGGGAATTTAAGAGGACACTGTACTGTAGCGAGTGCGGCATCAGCGCCGAAAAGTACAAGGACCTGTCACTCCCA<br>AGCACGCGCAAAACGCTCCAGGACTACTTCGACATTAAAGGGTATTGCCCCAAACAATATGCGCCTGAGGAATACAGCTTCTATTT<br>CGAGCAATGTTACACCGATCCCATGGCCCGAAAGAGGTTCATCGAGAATATGGTTAGTGGGAGGGAGCCAAGTATAGGTTACCTTT<br>GTCTCGCGGAGGCCGTTATGCAAGGCAAAGTTAAAAACATTTGGACTACCAACTTCGATAGCCTTCTGGAGAATGCCCTCCATAGG<br>CTTTACCCCATGAACAACGTTTTGGTGTGCTCCGAGGCTAATAGAGGCAGTGTGTGCCTGCTCAACCCGACGTACCCAGTCATAGG<br>CAAGCTCCACGGCGACTATCGCTATGATTGGCTCAGGAACACCGAGGACGAATTGCAGCGACTCGAGACCAGCCTTAAAGGTTACG<br>CGTCCAGCCAACTTACAGGGAAACAACTCGTCGTTATAGGATATAGCGGGAACGATGAGAGCATTATCAGTTTCCTCAAGGATTGC<br>ATAGATAACCCGGCACTGCTTACCAAGGGTCTGCTGTGGGCTGTACGACGCGGTTCCTGGGTAAACCCGAGGGTTAATGAGCTGAT<br>AGAACGGGCGCACAAAATTGGGAAACCAGCCGACGTGATCGAGATCGATGGCTTCGACCAATTGATGTTCTCAATATACCAGATCC<br>AGAACTACCATAATGAGTATTCGACGGCCAAGGCAGGCTCCTCCAGGTCGGATCTGACATCCGCCTCACGGGGAAGCCCGTGGAC<br>AGCTTTGTCAAGCTGAACGCTTACAAGGCTGAGTACTGCCCCCTTTCTGGATCACGTGTCGAGACAGACATCACATCCTGGAAGGAACT<br>TCGGACCATAACCGGCAGCAGTGACATCATCGCCGGTCTGTTCTCCAAACATATCTATTCTCTGTCTTCCGCAGACAAATTGAAGA<br>CCGTGTTCAGCAAGCACTTTCTCTAGCATTAACAAGGAGGAGGCTCCCGAACGGGACATTCGACGGAACGAGAGTGTGTACATT<br>GGATTGATTTACCAGCTTATTAAGCGGACCCTGCTTTCAAAAGGGATGGTGTCCTTCGCTAAGAATAAGGTCTATAACCCCGACAG<br>CTGCCGCAGCGAGCAAGGCTACCAAGTTTTTGACGCCCTGGAGCGCGGTCAGCTTCGTTGATGGAAACCTGTACCTGAATCTTA<br>TGCCCACGGTACATGTGAGAGGCTCAAATGGCGAGAGTCTCGACAAAGAGTCCTACCAAATACAAGTCAACCATGTGGTCAGCACA<br>ATCTACAATAAGCAATACAATGAGAAACTGCGGTTCGGGAGAGCTTGTGTCTGGACAGTGGTAGAATAATCTTCGAGAACGACGG<br>CTTCAGCATATCATTTGTCGCTCCCGCTGTCTCCCTGGGCGGCAACAATCGAAGAGCTAAGTGGCTTTCCATGCCGTCCTGCAAGT<br>ATGACGAACCACTCATGTCGCTTCTCAGACACTGACAAAAGCAAACAGAGTTATTAACCAACTGAAGGGACTCTGCCAGTACGGGCA<br>ATCGACTGCTCTTATATCGGGATAGCACCACAAGGCCCAGCGTTAGGCTGGCCGTTCTGAGCCCGAACCAGGACATGGACCGAAT<br>TCTTGCACACCTCAATAAACTCAACACCCACGTCAAAACAGGGGCAGCGATAATTTCCTGCCCCACTATGAGGGCTTTGAGCAAG<br>TTTACAGAAGGGCTCTGAGCGTCCCTACGAAGGAGCAGAGCAACATCTGCATCGGATACAACGTGAACGCCATCCTCAAAATGTCT<br>CCTGCAGAGTTTCTGGCTTTTATGAAGCGGGTATAGAGAAATACTCCCTTCGGTCAAGCGATTTCGATATACTCGTTATTTACAT<br>CCCAGAGTCATTCGCGCATTTCCGGACAGCAACCGAAATTAGTAGCGACTACAATCTGCACGATGCGCTCAAACTGTATGCCACGG<br>ATAAGGGGATTATCCTTCAACTCATAGAGGAGAAATCTGTGAAGTCATACGACCCCTGCAAAGTAATGTGGGGCTTGTCCACCTCA<br>CTCTACGCGAAGGCGACAGGGGTACTTTGGCATCCAGAGGCAATTAGAAATGACACGGCCTACATAGGGATAAGCTACGCTTTCAG<br>CGAAGAGAAAGGATTTGTATAGGCTGCAGTCAGCTGTTCGACTCAACCGGGACAGGTATTCGGATGGTCCTTAGAAAGATAAACA<br>ATCCGATATTTCTGGGGCGATCCAACCCCCTACATGAGGGAAGACGACGCTCGAATTATGATGACCGAGCTCAGGGAGCAGTATTAC |

TABLE 17-continued

Argonaute nucleotide sequences containing 2X Nuclear localization sequence (NLS) from Simian Vacuolating Virus 40

| SEQ ID NO | Sequence |
|---|---|
|  | CACAGCGCACCTGTGAATACTCTCAAGAGGGTCGTGATCCATAAGACCACGCCCTTCATACGGGATGAGATAGCCGGTATAATGCA<br>GGCATTTAACGGCATCGAGGTCGAGCTGGTTCAGATTCAAGACTATTGCTCTTGGAGAGGCATACGCTTCGGCGGTGAGCCTGGGA<br>AAACGGCGTTTGGGTTCCCGGTGAAGCGAGGTATGGCCGTAAAACTCGACCGAGAAAGCTTCCTGCTCTGGACCCACGGCTGCGTG<br>ATTCACCCGGAACTGTCAGGCACGCATAACTATTTCAAAGGTTCACGCGGTATCCCAGCACCCCTCCTGGTCCGCAGGTTTGCGGG<br>TAACGCAAGTGGCGACACATTGGCAAAAGAGATTCTGATGCTTACGAAGATGAACTGGAACTCCGGTGACAGTCTGTACAAAACCC<br>TTCCCGTGACCCTGGATTTTGCGAAAGTTCTCGCCCGCATGTCTAAGCAAGATGAGGCGATCTTTGATAAGGCGTACGACTTCAGG<br>TTTTTCATGTAGTAA |
| 93 | ATGCCGAAAAAGAAGCGGAAGGTTGAAGATCCAAAGAAGAAGAGGAAGGTGGGGTCTGGGTCAATGCTCCTTAATCATCTCCCAAT<br>CGAGTTCTCCAGCGCACAGTTCGCTGGACACGAAATTGCTTATGTCGACGGCGAGCAGTTGAGGTCCATACGACAGAGACTCACGC<br>GCACGCACTTCGTGTTGAGGGATGGGGACAATGTTCTGCTCTTCCCGTACGAACATGGAACCGCGACCGAGGGAACCAGGCGAACA<br>TTCGACACGGGCGTTAATTTCAGCGTAGCCAACGCCCTGGCGCGCAACGGCATGCTTCTGCGATTCTTCCAGCACTCTAGAAGTAT<br>TTCCGGCGTCCGACCGGTGAAATTTGTGAAAGACAACCAGAACCTGCTCACGGGTGACGTAGGCCGGTTGTTTGCTATATGTCCGG<br>AGTACAGTTTCGACATCCGACCCCTGGCACCTCAAGACGGCAGCCTTGTGAACGGGGTACTGGTAAACTTCTCAGCCCGATTTTTG<br>GTGAAGCCCTCCCTCGACGAATTGATTGCGCAGGGGCTCGACCCACGGGGCCTGTATGTTGTTAAAGAGGCAGAAAGAGAATCACC<br>CTACATCCTGCCGATGTTTAATCGGAGATTGGTAGGGCGGATCCAGGACGTGGTCGGAGGTATCGCCAAGCTGGTGGACGAGCGCG<br>AACAGGACCTCCCTGTACATGAACTTCATGTCGAGGCCAACCTGGTCAACTTCGAGAAAGTAGGCAGAGCACTGCTTGGCCGGGAT<br>TACGAGCGAGTGAGTCGACAAGTGCTTCCCACCCTCCATAAGGTGAGCGGCGCAGAGAAACAGCTCGATCGCTTGGTCCAGCTGCT<br>GACGAGCTTCAAAGACCTCCAGGGTGACATCCCGTGTTGCGACGGCCTGACCGTTAGACTGGCAGGCATACTTACAGATGTGCCCT<br>TCGGCAGTGAGGTGGGCCAATTCCGCAAATTGTCCGCGCCACAGTGCAGCCTCCGCCCAGGGGGAACTATTACGGTGCCGTGGCCC<br>GTGGACGGCAAACTCAATGCCAACGGCCCCTTTGATGCAGACGCCTTCAGCAGGAAGGAACCAACAATCGGCGTTCTGTTTCCGGA<br>GCAGCACAAGGGTAGTGTAGAAGAGCTGGCCGCTAAACTCAGAGACGGCGCACCGAGCGATGGAAAGTACCCAAGTCCATTTCCCC<br>AAGGAATGCCCCGGAAGTATAGACTTAGGAAGATGACATATGAGCTGACGCCCACGAAAGTTTCAGGGGACAGGGCCGCAGCCTAC<br>AAGAATGCCGCGCTTGCAGCCGCCCAACAAGAGCTTGATCTCGCTCTGGTGGTCATATCTGAATCAGATAAGGCGTTGCTTGGAGC<br>CGCCAGCCCCTACTACACTGCGAAAGCCACATTGATGAGCCAAGGCGTGCCGGTGCAGGCTATTACCATTGAGACTATCAACAGGC<br>TCAACCCCTACACCTTGAATAATCTGGCACTTTTCCCTTTACGCAAAACTCGGCGGGATACCTTGGACCCTGTCAGTTCAACAGCGA<br>CTGGTCCACGAGATAATTGTAGGGATAGGGTCTGCGAGAGTGGGCTTCGACCGCCTCTCAGAGCGGGAGAGGCTTGTCGGCATCAC<br>GACCGTGTTCTCCGGGGACGGATCATACCTTCTTGGCAATGCAACGACGGAAGCCAGCAGTACCGAATATAGGTCTCGCCTTCTGG<br>AGAGCCTTAGGGCGACTTTGGCAGAGTTGCGAAGACGATTTGGCTGGCAGCGGGGAGATAAATTGAGGATTATCTTCCACCAAAGC<br>TATAAGCGGTACAAGGAGACCGAAGCAACCGCCGTTAGCGACCTCATCGCCGAACTTGATGAATTCGATGTGGAATTCGCGTTTGT<br>GCAGATCAGTAGCGATCATGACTGGAAGTTGTTCGATGAGAGTGCCACAGGCGTTACGTATCAGTCCCGGCAAAGGGAGCGAAGG<br>TGCCGGAACGCGGAGTCATAGTCCCTCTCGGACCTCGCGCTGCGCTGATCACGTTGGTGGGTCCGCATCAACTGAAAACCGACCTG<br>CAAGGGTGCCCCTCCCCCATACTGGTGTCTATCCACCCGAGCTCAACTTTCAAGGATTTGAGTTACGTGTCAAAGCAGGTGTTCGA<br>CTTGACCTTTATGAGTTGGCGAAGCTTTAACCCAAGCACGCAGCCCGTTTCCGTGAGTTATCCCAACATGGTGGTGGATCTGCTCG<br>GTAACCTGCGGCAAATCCCCAACTTCAATCCCGACATTCTGACGACAAAACTGAGGGAGTCTAGGTGGTTTCTGTAGTAA |
| 94 | ATGCCTAAGAAGAAGCGAAAAGTTGAAGACCCCAAAAAAAAGCGCAAGGTCGGGAGCGGATCTATGATGGGAGCCAGCGATGAGTA<br>TTCCTTTTACGCTGAAAAGGCCTATCCCATAGAAGCGGACAGGCAAAAGTACTTCGAACAGCTGGCGTACAACAAAGCCCCCTACA<br>TTGGCTATAAACTCTGTGTCTGCTGAATAACGCGGGGCTGATAAAGTCTGTTTGGACCACAAATTTTGATGGCCTGACGGAAAGG<br>GCCGCTCACCAAATGAACATCACCCCCATCTGCATTACCCTGGACGACCCCGAGAGGATTTTAGGAATGAGAACTCTCACGAACT<br>GCTGTATATCGCCCTTCACGGCGATTACAAATATAGCAAGCTCAAAAATACCACCCACGAGCTGGACACCCAAAACAATATCTTCA<br>GAGACGCACTGAAGCGATACTTCGTGGATAAGAATCTTATTGTCATAGGATACAGCGGCCGAGATAAAAGCCTGATGAACGCACTT<br>AAAGAGGCATTTTCCCAATCCGGCTCCGGGCGACTGTACTGGTGTGGCTTCGGGGACGATATATGCAGCGACGTTAAGGAATTGAT<br>AGACATCGCCAGGAGCAATAATCGGATTGCCTACTTCATCCCGACGGACGGCTTCGATAAGACCATGCTCCAACTTAGTCGCGCCT<br>GTTTCGAGGACGACATTGTGAAGCAGGAGGAAATCAAAAAGCTGATCAAGTCCACGATCAAGAAGGACGAGACGAAGACCAGCTTC<br>CGAATCGAGAGCAGCAGGAACGATAAACTTATTAAGTCTAACCTGCATCCCGTGGCGTTCCCCAAGGACGTGTACCAGTTCGAGAT<br>TAAGACTAACGGCGAGCATCTGTGGAACAACATAGACCAGATCATTGGCGGCAATAAGGACATAGTTGCCGTACCGTTCAAAGGTA<br>AGGTGTTCGCTGTCTCAAGCATTGCGAAAATCAAGGAGAGGTTCGGGGGCTATATCAAGGGGGAAATATTGAAAGACCCGATTGGC<br>GTCGATGACATCCGCAAAGTATCTGTGTTCCAGCGGCTTATGATGAAGAGCATCCTGATTGGAATCTCTGAGTTGGCAAATCTGGA<br>AACTGATGGAAAGTGGCGCTTTGGAAAAAGAACACCCTGAGGCGAATCGTAAACGGCAGGAGTATTTCATCGCCGACGCTGTAG<br>AGCTGTCCTTTTTCTTCGGAAAAGATACCAAGTTTGCCTATCTCAGCATCAAACCGACCATTTACATTTATACACATAGCGACGAA<br>TTCATACCGAAGGATATAAAGCTGCAATTCACAAAGGAGAAGTTCGACCGACTCTATAATGCACAATACGACCAATCCCTGGAGGA<br>GTGGAATAATCTCATCTTCCACAACAACAGCCTGAGGTTCACCTTTCCCGTACTGACCACCTCCGACATGAGCTTTAGCATCAGCA<br>ACAATGTGGCCTTCTCAGGAATTAAGGTTTTGAGTGACAAGTATAAGAGCTACCCCGTTTCTATCGAGCAGAAGCGCATAGTTTTC<br>AAGGGCGTGGAGTTCCTGGAGCCTCCGCTGCTGTTTCAAAATAAGAACGACTTCAAGTCACGCGACTTCCATCCCATGAGGGG<br>ATTGATTAACCACTACCCCTTCGACTACCAGAACAATGGGATCACCAACACGTTTAATGTCAAACTCGGCGTGTTGTGCTCCTCTA<br>AGTACTCTACTAGGCTGTACGAGTTTCTCATGAAATTGAATGCCCAACATAAAGCGCCCGAGAAAAACGAGTACATAATTGACTAT<br>GCTGGATTCAACCAAATCTACAACATCCCTATTGAGATACCGCTGGTAAACGACGAGAAGTGGATGGACGTAAAGTTTAATAGCAG<br>CGTGAGTATCAAAGACGACGCTCTCAACCTGGCAAGAATCATATGCACCCAGATCGAGGCGCTTCACGAGTCTTACAAAACTGACA<br>TGACCATCGTGATCTTCATTCCCAACGAGTGGCAACCCTACAGACATCTACGAGGAGGACACATGGGTTTTTGACCTCCACGACTAC<br>ATCAAAGCATATAGCGCTCAGAAAAGAATTTCCACGCAGTTCATAGAGGAAGATACTCTGAACGATTCATTGACGTGCAGATATA<br>TTGGTGGCTCAGCCTTAGTTTTTACGTGAAATCCTTGCGGACGCCGTGGGTTCTGAATGCTAACAATAATGAGACCGCTTACGCGG<br>GCATCGGCTACAGTATAAAGAATAACAACGGTGAGGCGTCAATTGTCCTCGGGTGTAGCCATATTTACGACAGCCACGGCCAGGGC<br>CTCAAGTACAAATTGAGCAGAGTGCAGGACTGCTACATCGACAACAAGCGGAACCCCTACCTGAGCTACAATGAGGCCTACAACTT<br>TGGCATAAGTATCAGGGAGCTCTTTCTGCACAGCATGGAGTGCGATAGAAACCACATGGAGTTCAAAC<br>CCGACGAAGTGAATGGCATTGTCGACTCACTGCAGATAGCGGGTATCGAGAATATAGACCTTATCTCCATCAACTTCGAGCGGGAA<br>GTTAAATTCATGTCCACTAAATCCAACTACGGGCAGTTGCAAATCGATAACTTTCCCATACGCAGGGGCACCTGTATCGTGGTGAA<br>CGACTATGAAGCCCTTCTCTGGACCCATGGAATTGTGCCGAGCGTTAAGTCCGATAACAGGACCTTCTATCTGGGCGGACGATCTA<br>TTCCTAGCCCTCTTATCATTAAGAAGCATTACGGTAAGAGCGATATCAACGTTATCGCTACAGAGATACTGGGTCTTACCAAGATG<br>AATTGGAACTCTTTTGATCTCTACACGAAGCTGCCGGCCACCATCGATAGCTCTAATCAAATCGCCGGGATCGGGAACCTGCTGAC<br>TAGGTTCGAGGGCAAGACCTATGATTACCGGTTTTTCATTTAGTAA |

TABLE 17-continued

Argonaute nucleotide sequences containing 2X Nuclear localization sequence (NLS) from Simian Vacuolating Virus 40

| SEQ ID NO | Sequence |
|---|---|
| 95 | ATGCCCAAGAAAAAGAGGAAGGTCGAAGATCCTAAAAAGAAAAGGAAAGTCGGGTCCGGTAGCATGCCCACCCAGTTCCAGGAGGT<br>GGAAGTGATACTCAACCGCTTCTTTGTAAAGAAACTGTCTCGGCCCGACCTTACGTTCCATGAGTACCAATGCCAGTTCACCCAGG<br>TTCCAGAGCAAGGCAGCGAACAAAAGGCCATCAGCAGCGTGTGCTACAAGCTCGGTGTGACCGCCGTGAGGCTGGGCTCATGCATC<br>ATCACCAGGGAGCCCATAGACCCTGAAAGGATGCGCACCAAAGATTGGCAGTTGCAGCTGATCGGATGCCGAGAGCTGAGCTGCCA<br>AAACTACCGAGAGAGGCAAGCTTTGGGAGACTTTCGAGCGAAAAATCCTGGAGGAAAAGCTCAAGGAAACATTTAAGAAGACCATCA<br>TCGAGAAGGACTACGAGTTGGGCCTGATCTGGTGGATATCAGGCGAAGAGGGACTGGAAAAAACCGGTCACGGGTGGGAAGTGCAC<br>AGGGGCAGGCAAATAGACCTCAAGATCGAGACGGACGAAAAGTTGTACCTGGAGATCGACATACATCACAGGTTCTACACCCCCTT<br>CAAGCTGGAGTGGTGGCTGAGCGAATACCCCAACATCCAAATCAAGTACGTGCGCAACACGTACAAGGACAAGAAGAAATGGATAC<br>TGGAGAATTTCGCCGACAAGAGCCCCAACGAGATTCAGATAGAGGCCCTTGGCATCAGCCTTGCGGAATACCACCGGCAAGAAGGT<br>GCTACCCAGCAGGAAATCGACGAGAGTAGGGTTGTGATCGTCAAAAAGATCTCTGACTACAAGGCGAAACCCGTGTATCACCTGTC<br>TCAGAGGCTGTCCCCGATACTGACCATGGAGACCCTTGCCCAGATCGCCGAGCAGGGTCGGGAAAAGAAGGAGATACAGGGCGTGT<br>TCGATTACATTAGGAAGAACATCGGCACGAGGCTGCAGGAGAGCCAGAAGATCGCGCAGGTCATTTTCAAGAATGTTTATAACCTT<br>AGCAGCCAGCCCGAGATCATGAAGGTGAACGGTTTTGTAATGCCACGCGCGAAGTTGTTGGCAAGGAACAATAAGGAGGTCAACCA<br>GACCGCTAGGATCAAGAGTTTCGGCTGCGCTAAGATCGGAGAAGACGAAGTTCGGATGTCTCAATCTGTTCGACAACAAACCGGAGT<br>ACCCGGAGGAGGTACACAAGTGCTTGCTGGCGATTGCGCGGAGCAGTGGGGTCCAGATAAAGATAGATAGCTACTTCACGGGGAGC<br>GACTACCCGAAAGATGACTTGGCCCAGCAAAGGTTCTGGCAACAGTGGGCGGCACAAGGAATAAAGACGGTGCTGGTCGTGATGCC<br>CTGGTCCCCTCACGAGGAGAAGACAAGACTGCGGATCCAAGCTCTTAAAGCCGGCATCGCAACTCAATTTATGATCCCCACGCCCC<br>AGGATAACCCATACAAAGCATTGAACGTTGCTTTGGGTCTGCTCTGCAAAGCCAAATGGCAACCCGTTTACCTGAAGCCCCTGGAT<br>GACCCCCAGGCCGCAGACCTGATCATCGGCTTCGACACTTCTACCAACAGGCGGCTCTACTACGGTACAAGCGCCTTCGCGATTCT<br>GGCGAACGGCCAGTCACTGGGCTGGGAGTTGCCTGACATCCAGAGGGGCGAGACATTTAGCGGCAAAGTATATGGCAGGTAGTGA<br>GCAAACTTGTGCTGAAATTCCAAGACAACTACGACAGCTACCCTAAGAAAATTCTGCTTATGAGGGATGGACTGGTTCAAGACGGC<br>GAGTTTGAACAGACCATAAGAGAGTTGACCCACCAAGGGATCGACGTGGACATCCTGAGCGTGAGGAAGAGCGGTAGTGGCAGGAT<br>GGGAAGAGAACTGACAAGCGGCAATACTGCCATCACCTATGACGACGCCGAAGTGGGAACCGTGATATTCTATTCTGCCACCGACT<br>CATTCATACTGCAGACAACCGAGGTAATTAAGACAAAAACGGGCCCACTCGGTTCCGCGCGACCGCTCAGAGTGGTTAGGCACTAC<br>GGGAACACCCCGCTTGAACTGCTCGCGCTGCAAACGTACCACCTGACCCAATTGCATCCCGCCAGCGGCTTTCGGAGCTGTAGGCT<br>CCCCTGGGTTCTGCACTTGGCAGACAGGAGCAGCAAGGAGTTCCAACGGATCGGTCAAATTTCATTGCTCCAGAACGTGGATAGGG<br>AGAAGCTGATTGCAGTGTAGTAA |
| 96 | ATGCCAAAGAAGAAGAGAAAGGTTGAGGATCCCAAGAAAAAGCGGAAGGTCGGCAGTGGCAGCCTGGGAGCCGGTGCCAGCATCAG<br>TTCCGGCATCCAAAGCGCTAATGACTGCATTTGGGACTGGAAGTACTCTATCTACCAAACTAACTCCGGCAGTCAACGAGTGGCCC<br>TCGTGGACCCTAAGAAAATCCGACGCCTCCAAGTCTATCATCCAGAAGTGGCTGGATAATCAACCGAAATTCTCACAGATCGAAGCC<br>CATCAGGAGTACAGCTTCTACGCCCAGGCGGCTTACCCCATTGAGGCGGACCGAATCAAATACTTTCAGAATCTCTTCCAGGGGAA<br>GTCCCCCTATATCGGCTACAAATTGCTCTGCCTGCTGAACAAGTACGGTGTAGTGAAATCTGTGTGGAGTACCAACTTCGACGGCC<br>TGGTCGAACGGGCAGCACAGCAAGCCAACATCACCCTGATCGCCATCAATCTTGACTGTGTTGACCGCATATATCGAGCAGAAAGC<br>GTGAATGAACTTCTGTATATCGCGCTCCACGGGGACTACAAGTTTAGTACCATAAGGAATAACCGGCGAATGAGCTCGACAGCCAGCA<br>CACCGAGTTCGTATCTGCCATGTGCCGGTACTTCGTCGATAAAAACTTGATCGTCATGGGATACAGCGGACGCGACAAGTCACTTA<br>TGGACGCCCTGGTCCAAGCGTTTAGCAAGAAGGGTGGGGGAGACTTTATTGGTGCGGCATGGGCGAGACCATCACGATCGAGGTG<br>CAAAACCTGATACAGAGAGTGAGGACCGCAGGCCGGTCAGCTTATTATGTAGATACCTCTGGGTTTGACAACACCATGCTGTCACT<br>GGTAAAGTACTGTTTTTTCAGAGGACGTCGCCAAACAGCGAGAATAAACGAAATTTTGAAAATTGTGGAACCGGAGCAGATTACTC<br>CGTTTGAGATTCAAAAGAGCCAGAACAAACGGTATCTCAAGAGCAACCTGCTGCCAATCGTGCTTCCCAAGGAACTCTTTCAGTTT<br>CAGATCTCTTATAACGACACGGCGGACAGGTGGGGATTCTTGCGCGAGAGGATTAAGGAGCGGGAAATCATAGCAGTCCCGTACCA<br>GGACAAAGTATACGCAATCAGCACGGTCTCCATCATTAACGACGTTTTCAAGGACTGTCTCGTAAGCGAGATTGAGCGCACGTCCA<br>TCTCTCTGAATGAGATCGAGCGCAATGGCTGCTTCAAAGAGCTGTTTCTGCAAAGCAACAACGACTTGAAGTTCTTCATTTCCAGTAATAG<br>CTGGGCATCAACTACCGCCACGGCATCATTTGGAAGAAGGAGGCGCTCTACACTGAGCCGGCAAGACCGTACACGAGGCCATAGA<br>ATGCGGCTTGTCTTTTATACCGCAAGCGAACTACGCTTTGATTAGCATCACACCAAGTTTGCACATCGAATCCAGCAGCCCGATCG<br>AAAAAGAGAAGAAACAAGAGTATAACAGGCGGTACCTTGACAAGATGAGGAATAAAGAGTACGAGGAAAAGATCCAGGAGTGGTGC<br>AACATACTGTTCTCCGGTAACAAGCTCGTTTTTGACATCCCGCTGCAAAGCAACAACGACTTGAAGTTCTTCATTTCCAGTAATAG<br>GGGTTTCGCCGAGGTATACAATTACGGTAAGGACATCGAGAAGAGCTACACGCCCAATGCTTACAATACGAAACAGACCATTTACT<br>ACGGCATGCAAATCGAAGAGCCTCAGTTGGAGTTTATCAACTCCATAATCAGTAGGCCGTTCTATGACGTTAACCCAATGAGGGGC<br>CTCTCAAATCACAAACCATTCGACGCGGACTACTATGACAAGTTCCCCCAGGATGTGTGTTTGGGCATTGTGTGTCCGACCAGCTA<br>CAGCCTGATGTTCTCAGAATTCCTGAAGCGCCTGAACACTAAGATCCCAGCACCGAAGTCATCCGACTACATCCACAACTATATTG<br>GCTTTAACAGCATCTACAACTGCAGGCTGGACATACCGGACATCAATGCCGATCGCTGGGTGAGCATCGGCGACAACCCCCAGAAC<br>GCGGAGGAATTGCCCGCAACATCTGTATGGAAGCAAAAAAGCTGAGTGAACAATATCCGGGCATCGTGGTTAACATATTCATCCC<br>TACTATCTGGAGCAACTACAGAAACTTTAAACACAACGGTGAATTCTTCGACCTGCATAACTACATTAAAGCATTTGCGGCACAAA<br>ATCGCTTCACCACGCAACTCATCGAGGAGAAAACTGTTTGTAACGACGATGATGTGCGAGATATCCTGGTGGCTTTCCCTTGCCCTT<br>TTCGTTAAGACCCTGAGGACTCCGTGGACACTGGCTGACCTTAACCCCAACACCGCCTACGCGGGGATAGGGTATTCAGTTAAAAA<br>GCAGGCAAGGGCAGGACAGAGATCGTACTGGGGTGTAGCCACATTTACAATGCGCAGGGACAGGGATCAAGTACAAACTGAGCA<br>AGGTCGAGCACCCACAGTTCGACAAAAACGGAACCCATTCTTGAGCTTCGAGGAAGCCTTCAAATTCGGGATGGATATTCTTAAT<br>TTGTTCCAGAGTGCAATGGAAAAACTGCCGCAGAGGGTGGTTATTCATAAACGGACGCCTTTTAGGGAAGAGGAAATAGAAGGGAT<br>TACCAGCGCCCTCAACGGCCAGGGATCACGGAGGTGGACCTGATCACTATAACGCAGGAGCGAAACATTAAGTTTATAGCACAGG<br>TTGTCTCCTTCGGCCAACTCAATACCGACGGCTATCCCGTCAACAGAGGCACTTGCATCAAGCTTAGCTCTCGCAATGCACTCCTT<br>TGGACCCACGGCGTCGTCCAGAGCATTCGAGACAAAAGACGGTACTACCAGGGGGGCAGGTGCATTCCGAGCCCGCTGAAAATCAC<br>TAAGTATTACGGCAACGGCGATCTCCAGACTATAGCTAAGGAGATCATCGGTTTCACGAAGATGAATTGGAATAGCTTCAACTTCT<br>ATACGAAGCTGCCAGCGACCATTGACACTAGCAACACCCTGGCCCAAGTGGGCAACCTTCTCAGGAACTATAATGGCACCACCTAC<br>GATTATCGCTACTTTATCTAGTAA |
| 97 | ATGCCTAAGAAGAAGAGGAAGGTGGAGGACCCAAAAAAGAAACGAAAGGTGGGGTCTGGCTCTATGCCACACACCTCCCTGCTGTT<br>GAACTTTCTGCCCGTCTCTCTTAGCGGCGACACACGCATCCATGTCGGCTACCGGCCATAGACGAGGATGTGCGGGAACTGA<br>GGGAGGAGTTCGGCGAAAGCCACGTGTTTAAAAGGGATACCAGGAGGCACGATAAGCGAGATACCGGTCATCCCCGGAGCCGAG<br>CCCCTTAGCGACAAATCTACTGGCGTGGATCTTGCCGAAGCGCGATGGCTGTGGAAACCACTTCTGAACGCTGCATTGCTTCGCCT<br>CTTCAGCGGAAGCAGAGAGATCACCTCTGATTATCCAGTCAGCGTGCTTGGTAACCCCAAGAACAACTTCATCAGCCATGCCAATC<br>TCCCCGACTGGGTGAGAATCCTGCCCCTTCTGGAATTCGAGAGCCGAACCCTGTTCGGTGGTAAATCCGGTCCGCAGTTTGGGCTT<br>GTTTGCAACGCCCGAACTAGGCACCAGGTCCTGGCAGGCTGCGACCATCTCATTGAAAGAGGGTATAAGTCCCATTGGCCGCTATGT |

TABLE 17-continued

Argonaute nucleotide sequences containing 2X Nuclear localization sequence (NLS) from Simian Vacuolating Virus 40

| SEQ ID NO | Sequence |
|---|---|
|  | TCAGATCGACCAGCCACAAAGAGACTCCAGACTTGCGCCACGCGGTCTGACTGTTGGTAAGGTGAGCTCTATCGATGGGGACACGT<br>TGATCCTGGAGGATCACCGAAAGGGCTACGAGCGCGTGAAGGCAAGCGACGCTCGCCTTACCGGCAATCGGGCGGACTTCGACTGG<br>TGCGTGAACGCGCTGTTGCCTGGACAAGGTCAAGCAACGCTGAGCAGGGCGTGGGACGCCATGAGCGCCCTGAATCAGGGACCCGG<br>CCGCTTGCAAATGATCAATCAGACAGCTGAATATCTGAGGACCGTGAACCTTGAGGCGGTTCCTGGGGTAGCATTTGAGATCGGCG<br>AGTGGCTGAGTTCTACCGATGCTCAGTTTCCTGTGACCGAGACCATCGACCGCCCTACCCTCGTGTTTCATCCCTCCGGCCGACCC<br>AACGACACTTGGAACGAGAGGGGGATAAAGGACAATGGCCCGCACGACCAGAGGACATTCACCCCCAAACAGTTGAACATCGCCGT<br>GATTTGCCAGGGCAGATTTGAGGGACAGGTAGACAGATTCGTGGGCAAGCTGCTCGATGGCATCCCGGACTTTCAGTTGAGGAACG<br>GCAGGAAGCCCTACGACGACGGTTTCCTTAGCCGGTTTAGGCTGGAGAGGGCCAACGTGCAAACCTTTCAGGCTAACAGTGCGTCC<br>CGCGAGGCTTACGAAGCAGCGTGTGAGGACGCTCTGAAACATGCCGCTGATAACGGCTTTGGCTGGGATCTGGCTATCGTTCAAAT<br>CGAGGAGGATTTCAAGGCGCTGCCTGGGCCCCAAAATCCCTACTACGCCACCAAGGCAATGCTCCTCCGGAACAACGTAGCCGTGC<br>AGAACATCAGGATCGAAACAATGAGTGAGCCTGACAAAAGCTTGGTCTACACTATGAACCAGGTTTCTCTTGCTTGCTACGCAAAG<br>CTGGGTGGTAGACCTTGGCTCCTCGGTGCCCAACAGAGTGTCGCGCATGAGTTGGTGATTGGACTGGGCAGTCACACCGAGCAACA<br>AAGCAGGTTTGATCAGTCCGTGCGATACGTAGGCATCACCACCGTATTTTCCAGCGATGGAGGCTACCATCTGAGCGAGCGAACCG<br>GAGTAGTGCCCTTTGAAGATTACGCCAAGGAGCTGACAGACACCCTCACTAGGACCATAGAGAGGGTGCGAAGGGAAGACAATTGG<br>AAGAACACTGATAGAGTTCGCCTGGTGTTCCATGCTTTTAAGCAGATTAAGGACATCGAGGCCGAGGCCATCAAACAGGCAGTGGA<br>ATCTCTTGATCTGGAGAACGTTGTGTTCGCATTCGTCCATGTGGCCGAGCACCACCCTTATTTGATCTTCGACCAAAACCAAGAGG<br>GATTGCCCCACTGGGAAAAGAACAGGAGCAAGCGCAAAGGCGTCTTGGGACCCAGCAGAGGCGTGCATATAAAGTTGGCGGACAGC<br>GAATCCCTTGTGGTATTTGCTGGTGCTAGCGAGTTGAAGCAGGCGGCACACGGTATGCCTCGGGCCTGTCTGCTGAAGCTGCACAG<br>AAACAGCACCTTCAGGGATATGACCTATCTGGCGAGACAAGCCTTCGATTTCACCGCCCACAGCTGGAGGGTGATGACCCCTGAAC<br>CATTTCCGATCACAATAAAGTACAGCGACTTGATAGCAGAGCGATTGGCGGGTCTCAAACAAATAGAGACCTGGGACGACGATGCC<br>GTGAGGTTTAGAAATATTGGCAAAGCCCCCTGGTTTCTGTAGTAA |
| 98 | ATGCCGAAGAAGAAGCGAAAGGTCGAGGACCCGAAAAAGAAAAGGAAAGTGGGGAGCGGCAGCATGCAGCAGGAGATCCAGCTTAA<br>CATCATCCCCTTCACCGCCCCTGTGGAAGAGGCAGAGTTCGCTTTTTACACCGCCAAGCAAGACGGCTACTGCCCCATCCATAAGG<br>ATGACCTGAACGGGGCCATCGAAGGCCTCGTGGATGAATCAGACCTGCACTACGGCAACTGGCTGTACACTGACTTCGCTCCCGCC<br>AAAGAGAACGCCATCATAATTAGCGTCAATCTCAATGACTGTAAGTACTTCGCCCAGCACTACTACAGGCACCTTATCAGGACCCA<br>CTTCAAGGGAGTGGCCGACATCATGAGGAAGAATTTCACCAACAGAATCGAGGTCTGGTTCCACAATACCAAAGCCAGCTCTACCA<br>AGTTTAAGGTCTATAACCAGTTTACCCTCAAGGTACAGCACAACAGGGTGACGGACGGACCGGAACTTGTCGTGTCCTTCGACGGG<br>ACGACGAAGGTGCTGAACAAGTCTATCGCCGAGATACACAACTTCAAAACGGAGCTTTACAACTGGATAAACTGCAACGGCGAGCT<br>TAATCGCTGGAAATACCTGACCGACGATCAGAAGCTGAATCACGAAAAGAACTACCCGGTAGTGTCAAACACACTTAAACCGCATT<br>TCGACATTGCCTTTGACGTTCCCGATTTTAAGAACCGGTATCCCAAATACTTCACTCTTCTGAATGACTTCTACAACAACTATCTG<br>AATACAGACGCCTTTACTGCGATCTTGCCGCTTTCCGCTGACGGATTCTTCAAGCCAAATGGCCTGCTGCAGTGCAGAGGATCAACGG<br>CACTAGCAATGAGCTGCAATTCGGCAATGGCGTCGGCGTGGAGCCCAAAAGGGATCTCAAGCGCCTGAAGCCGTATAAACCCGTGC<br>CCAAACCCAGCAACGTAAAGTTTTTCTTCATCTATCACAAGCCAGATAGGGAGCATGCGGTCAAAAACATCTGGCAGTATTTCAAA<br>GACGGATACAACGGCCAATACCCCTTCCCCAAGATGGAGGAATACATATCTCAGCCCTTCGAGCTTGAGGAGAATGGATCTATCTC<br>ATTCGACAATATCGACGACGCGGTAAGCGTTGTCCAAAAAGCCATCAAGAACAAGGATCGGCTGCCCGACACTAAATACTTTGCGG<br>TATACATCTCCCCCGTACCAAAATGGGAGAAGGACCCTAAACGGAATAGTATCTACCATCGGATGAAAGAGATACTCCTGTACGAG<br>GGGATCACCAGCCAGGTGATCTGGAAGGAGAACATTAGCAAACCGGCTTTCAACCTCTTCTTGCCTAACATCGAAACCGCCATACT<br>GGCCAAGCTGGGAGGCGTCCCCTGGAGGCTCAAGAGGGACACCACGAACGAGTTGATCGTTGGCGTGGGTGCTTTCTACTCAATCA<br>CGCGGAAGTCCAAGTACGTGGGCTCTGCATTTTGCTTCAATAACGAGGCATCTTTAAGGGGTTCGACTGTTCCAGTGCCAATGAC<br>ACCGACAGCATCGCGGGCTCTATCAGGGAGGCCGTGGGAAAGTTCATCGCGTCTAATTACAAGGCCACAAGGCTGATCATTCACTT<br>CTATAAGGACCTGTCAAAGAAGGAGCTCAAACCAATCATCGATACACTTCACGCCCTGGGCTTGCCCATCCCAGTGATAGTCGTGA<br>CCATCAATAAAACCGAGAGCAAGGAACTCCTGGCATTTGATACCAGCTCACAAAAGCTCATGCCCTACTCTGGCACCATCGTGAAG<br>GTGGGAGCCAAGGAGTACCTGCTGTTCAACAACACGCGATACGGGGAAGCATCCGCCCCAACGGATCGCGAGCACCACTTCCCGGT<br>GAAAATCAGCTTTTTCTCAGACAAGGCGGAGCTGTTGGACGATCCCGCACTGATCAACCAACTGATCGACCAGGTGTACCAGTTCA<br>GCCGCATGTATTGGAAAAGCGTGAGCCAACAGAACTTGCCCGTAACCATTAAGTATCCCGAGATGGTGGCGGAGATTTTCCCATAC<br>TTTACCCACGATAAATTGCCCGATCATGGAAAGGAGAGCCTGTGGTTCCTGTAGTAA |
| 99 | ATGCCCAAGAAAAAGCGGAAGGTTGAGGACCCAAAAAAGAAGAGGAAAGTTGGCAGCGGGAGCATGGAAAATCTGACCCTGAATAT<br>CATCCCTTTCAGCCACCCCGTGCAGGAGCTTGAGATCGGCTTCTATAAGCAAGAGAAACAGGGATGCTACAGCCTGTGGAAGGGCG<br>AGTACCCGCAGTCATTCTGGGACGACTTCAACGAGGAAATGCAAAATTGCGACAAACTCTACACCAACTTCATTGACACGGAAAAC<br>TGTGATTACAAAGCCAGTGTGGACTTTAGCAAAAACAGACGCCTGGCGGTCCATTACTACAGCAGGCTGATCTACAACTACTTTGA<br>AACAGTGGCAGATGCCGTGAAAATCAACTTCGTGAAAGATATCCAGATATGGTTCAAGGACGAGACCAAGAGCACCGCCGTCTATA<br>CCAGTTACAAGCGGTTCACGATCAAGGTCCAGTTCCATAAGGTGACCGAGTCCCCAGAGCTGTTGATCAGCTTCGATGGCAATACC<br>ACGGCCTATAACAAAAGTCTGGCCGAGTTGGACGATTTCCCTCCCGAGCTGATTAACTACGTTAAGTACAATACCCAAGTGGTGAA<br>GTACGAGTTCGCCGAGGACGCTATTAAGCAGCATATCGAGGAGCTGTACCCGATCCTGAGCAACCCCATCAGGGACTACCTTAAGA<br>TTGCCAGGCCCGATTTTAAGAGGGGCAACAAGTATAAGCCCTACTACAAGAACATTACAGACTTCTATCAACCACCTGAACTCC<br>AAAGAGTTTAAAGCTATCCTGCCTATCTCCGAAGACGGTTTCTACAAAATGCCTAAGCACAAGGTTCACAAAACCAGCTTCAATAG<br>CAATAAACTGAGATTTTTCAATAACACGGACATCGTGCCCCACAACGGGATGAAAAACATCGGCCCTATAAGGCGTCCCCCCACC<br>CCAACGTGAGGTTCTTCTTCATCTACCATAAGCCAGACCGAAACTTCGCCGTCAAGACGCTGTACGAATACTTTACGGAAGGGTAC<br>AAGAGCCCAGAGGGCTACCTTTACTTCAAGCCTCTCAAAACCTACATTAAACAGCCCTTTCTCATCAAGGATACCATCAGCATCGC<br>GTTCGAAAGCCCGGAAAGCGCTCTGCGCGAAGTCAAGCAGGGTTTGCTTAACCTGGAAAAGCAGCCCAATACGAAATACGTCGCTA<br>TCTATGTGACCCCCATACATAAGACCGAGACCGACGAGCAGAGGAAGATGCTTTATTACCAGGTCAAGGAAGAATTGCTCAAGCAC<br>GACATATCAAGCCAGGTGATATACAAGGACAACATTGGACATAAGGATTTTAGTTTCTATCTGCCCAACATCGCCATCGCCCTGCT<br>GGCCAAGATCGATGGAATCCCCTGGAGGCTGGACAGAGACCATAAGGAGGAACTTATCGTGGGCGTAGGCGCATTCACAAGCCTGA<br>ACCACAATATCAAATATGTAGCTAGCGCCTTCTGCTTTAACAACAATGGGGAATTCAAGGGATTCGACTGCTTCAAAGCGAATGAA<br>ACCGAACTTTTGGCTGGCACCATCGGCAAGCAAATCCTGAAGTATGTGGTGGACAACGGCGAGAGCGCCAAGCGCCTGATAATCCA<br>CTTTTACAAAAGATCAGTAACAAGGAACTCGAGCCCATAAAGAAAATGCTGAACAAGCTGAACCTGACCATCCCCGTAGTGATAG<br>TGACTATCAACAAGACACCTCAGAAGATAACGTGGCGTTTGACATCAGCAGCCATAACCTGATGCCCGTAGCCATCGTGAAGCAAT<br>AAAATAGGATGGGACCAGTACCTCCTTTTCAACAACACGAGATACAACGCCAGCGACACCGAGAAGGATAACCCCTTCCCTGTAAA<br>GCTGAGCTTCTCTAGCACCGTAGACAATTACTTCGACGACAGGAAGGTGGTCGAGGAATTGATCGACCAGGTGTATCAGTTCTCCC<br>GCATGTATTGGAAGAGCGTGAAGCAACAGAACCTTGCCCGTTACCATCAAGTACCCCGAGATGGCGGCAGAGATCTTCCCATTTTT<br>GAAGGCGATAAGCTGCCCGACTTCGGAAAGAATAACCTTTGGTTTCTGTAGTAA |

TABLE 17-continued

Argonaute nucleotide sequences containing 2X Nuclear localization sequence (NLS) from Simian Vacuolating Virus 40

| SEQ ID NO | Sequence |
|---|---|
| 100 | ATGCCCAAGAAGAAGAGAAAGGTGGAGGACCCGAAGAAAAAACGAAAGGTTGGCAGCGGCAGCGTGCAGCAGACAGTGGAGCTCAC<br>CCTCTACACAGAAAAACATCCCGACACCCACCCAGAGCTCGTTTATGCCGACGAGTGTTCCCGACCTGTGGCAACAGCACAGCGAGC<br>TTACGGGGGACAAATCTCTGTTCTACTCTCTTACGAACCCGGCAGAATGCAAGGGAACCCAGTACACAGTGCAAATCAACCTGAAT<br>AACCAGAAGCAGCGAAGGATCGCCAAGCACATAATTAGCCAGCAACTGTATAATCACTTCCGCCAGACCCAAATCGCTACCTTCGA<br>CAAGATCGACAATGTGGAGGTGTGGACCAAGAACACCCAACAGCCTACCCAGAATTGCACGGAGTACCTGAGGTTCAGCCTTATAC<br>CCCAATACGCCGTGTTCTCTGACTCATGGGAGCTGGTCGTGTCCTCAAATGGCATATCCACCGTGTATAACAAGCCTTTGAGCGCA<br>CTGGACCTTCAGACCGACCGATTCAAGGTCGTCGTTGGAGGGGAAGTGGTCAAGTACAAGAACCTGAGCCCCAATCAAAAGCAACA<br>AATAGACGAGGCCTTCCCCAAAATCAATAGGGAACTGGCCGCTGAACTGCATATTAACGAGAAACGCTTTCTCAATAAAGACAAGT<br>ATACGACCACCTACAACCACATTAACAACTTCGTGCGACAGCACCTTCTCACATCCGAGTTCCAGGCACTGTTTTGTCTGAGCGGC<br>GAGATGTTCAACGTACCCGAGGAGCGGATCGGCCAAGTGGCGAAGGGGGCGAACCTGTTGCAGTTTAAGGACGGCAAGACCGGCAT<br>TGACCCATTCAGCTGTGTGTTCGGCAGCAAGAGCATGGACGCACTTCGGCATCTACCAACCCAGCCTGAAGCCCCAGGTGAAATTCT<br>TTTTCATCGCCCAGCAAAGCGATATCAACGTGTGCAAAAGCCTGTACGATATTTTCACGAAGGGATACAAGCCTACGTGGACACA<br>GCCACTGGCGAGCAGAGGTACGTGTTCCCACCCCTGGCGACGTGCATCAAGCAGCCCTTTTCAACCGACCCCAAGGGGAGCATTTA<br>CTTCAGCGACCCTCAAAATGCCCTGAGCGAGATCAAGAGCCAGCTTAACAATAAGCCTCTTGACCCCCAAACGCAGTATGTGAGCA<br>TATACGTGTCCACCCATCCCTCGCGACGCCGTCAACAATCCCTACTACGGTCTGTACTTTCAGATTAAGGAGCTGCTGCTCGAAAAG<br>AGGATAACGTCTCAGGTGATCTATAAGGACCGCCCCAACAACCAGTACTTCAACTTCCATCGCCCAATATCGCGACTGCCATCCT<br>GGCAAAAATAGGCGGCATCCCGTGGCAGTTGAACTCCCACACGACGAACAAAGATCTGGTGATAGGCGTGGGCGCCTTCCTTAGCG<br>AAAAAGTTGGCGAGAGGTATGTGGGCAGCGCGTTCAGCTTTAACCCCAACGGCCTGTTTAAGAACTTCGACTGCTGTAAAGCGAAC<br>GATCTCGAATCTATCGTAGCCGGGATCAGAAAGGCCATCGGACACTTCGTTGTGGACAGCGAAACAAACCCCCAGAGGCTGATCAT<br>CCACTACTACAAGACCATGTCAAAGAGGGAGGCCAGGCCCATCACGCAGATGCTGAACACGCTTGGCCTCAACATTCCTGTATTGA<br>TCGTCACAATAAACAAGACGGAGACCAGCGACATTGTTATGTTTGATGAGAAACAGCAGGGCTACATGCCCCTTTCAGGCACCGTA<br>CTGAAGATAAGGAACGATGATTTCCTGCTCTACAACAATAGCAGGTACAAAGAGAACGAAAAGTCAGATATGCTTTTTCCAGTGAG<br>GATCCGCCTGAGTAAGATCGTAAACCAATCCGACAAAGACATCCCAATGACAGACGCCTTCAATTTGCTCAACCAAGTGTACCAGT<br>TCTCACGCATGTATTGGAAGAGCGTTAAGCAGCAAAACCTGCCGATCACGATAAAGTATCCAGAGATGGTGGCCGAGATAGTGCCA<br>CACTTTTCAGAAGCCGAATTGCCGCAGTTCGGAAAGAATAATCTGTGGTTTCTGTAGTAA |
| 101 | ATGCCAAAGAAAAAACGGAAGGTCGAGGATCCCAAAAAAAAGAGAAAAGTCGGTAGCGGCAGCATGAACTACACAGCCGCCAACAC<br>GGCCAACAGCCCATTGTTTCTCAGCGAGATTAGCAGCCTTACCTTGAAAAACAGCTGCCTCAACTGCTTCAAACTGAATTACCAGC<br>TGACTCGCGAAATAGGCAATAGGTTCGGCTGGCAGTTCAGTAGGAAGTTCCCTAACGTTGTGGTGGTGTTCGAGGACAACTGTTTC<br>TGGGTTCTCGCTAAAGATGAGAAGAGCTTGCCCTCTCCTCAACAGTGGAAGGAGGCTCTGAGCGACATCCAGGAAGTGCTGCGAGA<br>GGATATCGGAGACCACTACTACAGCATCCACTGGCTTAAAGACTTCCAGATCACCGCCTTGGTGACCGCCCAGCTCGCCGTGCGAA<br>TTCTGAAAATCTTCGGTAAATTCAGCTACCCCATCGTGTTCCCCAAGGACAGTGAAATTAGTGAGAATCAAGTGCAAGTAAGGCGA<br>GAAGTCAACTTCTGGGCGAGATCATTAACGATACCGACCCCGCCATTTGCCTCACCATCGAAAGCAGCATCGTCTATTCCGGCGA<br>TCTCGAGCAGTTCTACGAAAATCACCCGTACAGGCAAGACGCCGTGAAGCTGCTGGTGGGCCTGAAAGTTAAGACCATTGAGACCA<br>ACGGCACCGCTAAGATCATCAAAATCGCTGGCACTATAGGGGAAAAGCGCGAATACCTGTTGACTAAGGCCACGGGAAGCATATCC<br>CGGCGAAAGTTGGAGGAAGCCCACCTCGCACAACCCGTGGTTGCGGTGCAGTTTGGTAAAAACCCTCAGGAGTACATATACCCCT<br>GGCTGCCCTCAAACCTTGCATGACCGACAAGGATGAGAGCCTGTTCCAGGTCAATTACGGCGACCTCCTGAAGAAAACCAAGATCT<br>TCTACGCTGAACGACAGAAATTGCTTAAACTGTACAAGCAGGAGGCGCAGAGAACTTTGAATAACTTCGGTTTTCAGCTTCGGGAA<br>AGGTCCATCAATAGCAGGGAAAATCCAGACTTCTTCTGGACGCCCCCAATTTCATTGGAGCAGACCCCCATCCTGTTTGGGAAGGG<br>TGAGCGCGGTGAAAAGAGGGAGACCCTCAAGGGCCTTTCAAAGGGCGAGGTCTACAAAAGGCACAGGAGTACGTTGATCCTGCCA<br>GGAAAATTAGGCTGGCCATCCTTAAACCGGACTCTTTTAAAGTGGGCGACTTCAGGGAGCAGCTGGAGAAGCGACTCAAGCTGTAT<br>AAGTTCGAGACGATTCTCCCCCTGAGAACCAAATCAATTTTTTCTGTGGAGGGTGTTGGGAGCGAAAAAAGGGCCCGACTGGAAGA<br>AGCCGTAGACCAGTTGATAGGTGGCGAGATCCCCGTGGACATCGCCCTCGTCTTTCTGCCCCAGGAGGACCGGAACGCGGACAACA<br>CCGAGGAAGGCTCCTTGTATAGCTGGATCAAAAAGAAATTCTTGGATCGGGGGGTGATAACACAGATGATATATGAGAAAACTCTC<br>AACAATAAGAGCAACTACAATAACATCCTGCACCAGGTGGTTCCCGCATATTGGCAAAGCTCGGAAACCTGCCGTATGTGCTGGC<br>CGAGCCTCTTGAAATCGCCGACTACTTCATCGGCCTGGACGTCGGAAGGATGCCTAAGAAGAATCTCCCTGGTTCACTGAACGTGT<br>GCGCGTCCGTTAGGCTCTACGGAAAGCAAGGTGAATTCGTCCGATGTAGAGTCGAAGATAGCTTGACCGAGGGGGAGGAAATCCCC<br>CAAAGGATTCTTGAGAATTGTCTGCCGCAGGCAGAACTTAAGAACCAGACCGTCCTGATCTACAGGGACGGGAAATTCCAGGGTAA<br>GGAGGTGGAAAACCTTTTGGCTCGGGCACGAGCCATCAACGCCAAGTTCATCCTGGTAGAGTGCTACAAGACCGGCAGCCGAGAC<br>TTTACAATTTCGAACAAAAGCAGATTAATAGCCCCAGCAAGGGGCTGGCGCTTGCATTGAGCAACGGGAGGTCATCCTCATCACC<br>AGCCACGTTAGCGAACAGATCGGCGTGCCTCGGCCTCTCCGCCTGAAGGTGCACGAACTGGGAGAACAGGTGAACCTCAAGCAACT<br>TGTGGACACGACCCTGAAACTGACTCTGCTGCATTATGGCTCTCTGAAGGAACCTCGGCTTCCAATCCCCTTGTACGGAGCCGACG<br>CCATCGCGTATAGGAGGTTGCAAGGAATCTATCCAAGCCTGCTGGAGGACGACTGTCAGTTCGGTTGTAGTAA |
| 102 | ATGCCCAAAAGAAGAGGAAAGTTGAGGATCCCAAGAAAAAACGAAAGTGGGTAGCGGTAGCGTTCCAGGCGGTAGGGGACCGCT<br>GCTCGTGCTTAACTTCCTTCCCGCTCGCTTCGACGGCCGAGTTGATGCGGGCACCCTCCCCTTCGAGACCCCTGATAAATTGAGGG<br>CCATTAGGGAGGAACTGAGAACTTCCCATGTAGTTGTAACGCGGAGGAAAAGAGGTCGTATGCGTGCCCTTCGTTAGTGGCGCGAAA<br>TTGATCGGCAAACGAACCACTATCACCGCAGCGGGACCCGACTCGTCGTACAAACGAGTCTTCTCGAATCCAGCCTGAGGCGGAC<br>CTTGACCGAAAATGGAAGTACGAATTGCGCAGGGAAAACCCGCTCACCTTTGTGTCAAGGACGCCAGGAAGGGACCTGCTGGAGA<br>AGGCCCTTGGTCGGGAGTTGCCGGGACTCCATGTGTTCCCCGCTTACAGCCTGGACGTGCGCAGATACGGTCCTGGGGGGTTCAGC<br>GGGGTTGTTGTAGGATTGAAGACCCGCTATGAGATCGACCTGCCTGTCGGAGGTGCTGCTCAGGAGGGGCGTTCAAGTAAACGGCCT<br>TTATGTCCTGGCTGAAAGCCCCCTCGCGCCTACGTGGCCCTTCCAAGATCCCCACACCAGAAGGCGGCTCGTGGGACAAGTTGTCG<br>CGGTGGATGGCGACAAATTGCGAGTGAGGTGTAGGGACGGGGAGCTGGAACTTGATGCCGCCGAAGCATGGATTGAGCCCAACACT<br>GCCAACTTCTACGCCGTCCTGCGGAAGGCGTGCGGACGCTCTTACGAACGAGACTTTCACGCCCTGGAAGCCCAAGTCGTGTCCCT<br>GACTAACGCCCAGCAGCGAATCGCCGATACCAACAGGATCGCCGCCAACCTGATAGGCCTTGGTAAATTCGACATCAGTAACGGCT<br>TGACTGCCGAGCTGGGGAAACCACTCAGACTGACTTCCACTCAACATCCACACGTTCGGACTCTGGCCGAGCCCACATTTGTGTTT<br>GACCAGAGCGGAGACAAAACCGCGCCTTTTCCCGAGACCGGGCTGACCAAGTGGGGCCCATTGGACGCTGAGAGCTTTACACCCAA<br>GGCACCACACATCGCCGTGGTGGTTCCGCGGCAGTTTCAGGGTCGCGTCGAAACGCTGGTTGAGCGGTTCAGGAACGGCGTGAGGG<br>GCAGCAACGCCTATGCCGAGAGGTTTGTCCGAAAGTTTAGGCTCACCGACTGAGTACCTTCAGCTTCACCGTTTTCAGCGGTGACGCT<br>ACTGACGCAGCCGCATATAGGCAAGCGTGCCTTACCGCCCTGAGTAATGACGAGCAAATTAACCTCGCCTTCGTCTTCACATCAGC<br>CGTGCAGGAGCATCAAACGGGGACGACAGTCCCTATCTTGTCAGCAAATCCACCTTCATGAGCCAGGGTATCCCCGTGCAAGAGT<br>ATCAAGTGGAGAACATCATCGGGGATTCAAACTTGGCTTATCCCCTGTCCACGATGGCGCTGGCGTGCTACGCCAAACTGGGTGGC<br>ACCCCTTACGCCATAAGCGATCGAGGACGACCTATGGCACGAGAACTGATCTTCGGCATCGGGTCTGCCCAGGTAAGCGACGGAAG<br>GATGGGCGAAACAGAGCGATTTGTGGGCATTACCACCGTGTTCAATTACGACGGTAGGTACTTGGTTAGCAACGTTAGCCGCGAGA |

TABLE 17-continued

Argonaute nucleotide sequences containing 2X Nuclear localization sequence (NLS) from Simian Vacuolating Virus 40

| SEQ ID NO | Sequence |
|---|---|
| | CACCCTACGAAAGGTACCCGCAAGCCCTGCTTGACGCATTGCGGACTTGCATTGCCGACGTGAAGGTTAGGCAGGGATGGAGGTCC
GACGACTTTGTGCGGCTTGTCTTCCATATCTTCAAACCTCTGAAGGACAAGGAAGCACGCGCCGTAAAAGAGCTGGTGACGGAGCT
GACGTCTGAATATGCCAGCGTGGAGTTCGCTTTTGTGACAGTGGTGGACGATCACCCGTGGCTGGTGCTCGATGAAACAGCGATG
GGGTTAAGGTTGGGCGAGGGACTAAGGGCAAGCACGTAGCTCGGAGGGGTTTTGCCCTGCCGATTTCCAAAAGGGAGCTTCTTGTG
ACGGTTAAAGGTCCCCGGGAAATGAAATCCGATAAGCAAGGGGCTCCCAAGCCCCTCTTGCTCAAGCTCCATCGCGAAAGCACCTT
TACAGACATCGACTACCTGGCTTCCCAGGTCTTTCAATTCACCGCCATGAGCTGGCGCAGGCCATACCCTACCAGCAAACCCGTGA
CTATAAGCTACAGTGACCTGATTGCGGGACTTCTCGGAAAGCTGCGCACACGTGACGAACTGGAATAGCGACATGATCTACATGAAG
TTGCGCTTCAGCAGATGGTTCCTGTAGTAA |
| 103 | ATGCCTAAGAAGAAGCGCAAAGTCGAAGACCCCAAGAAAAAGCGAAAGGTGGGCTCTGGCAGTATGATTAACAAACTGCAATTCGA
CGAGTTTCAGAGGGCCATAGGTATTTCTAAGAACGACACCTTCAGTCTTTTGCTCGGAGCGGGTTGCAGCATCAATAGTGACATCC
CTAGCGCGGAAGACTGTATATGGGAGTGGAAGCGAGATATTTACAAAACAAATAACAGTTCTAGCTTCGGCTGGATTGACAATTAC
AAGAATCCCAAGACTCAGGAGATCATTCAGAACTGGCTCAACAACCAAGGCATCTATCCCGAACGCGGCTGCAAAGAGGAGTACAG
CTTTTACGCCTACAAATGCTATCCCATCGACGAACATAGGCGACAGTATTTTCAGAAAATCTGTAGTGGTAAAAAGCCATCCATCG
GGTACAAACTTATTCCCCTGCTTGCCCGAAAGGGCATGCTTGATAGCGTGTGGACCACGAATTTGGACGACCTCGTGGTGACCGCC
TGTATAGGCAACGGGATCCAGGCGATCGAAATCACGCTCGACTCCGTGCAAAGGTTGAACAACCGGCCTCAGAACCGACATGAGCT
TCCTGTGATCAAACTCCACGGAGATTTTAAGTATGGCGATCTTAAAAACACCGAGGAGGAACTCCTCAATCAGGATAAAACGTTCA
GGGAGAGACTTATTGAATACGTACAAGACAAGCACCTGATCGTGCTCGGCTACAGTGGCCGAGACACCAGCCTGATGGACACACTT
AAAGAGGCCTACTCAAAACAGGGGGGGTGGAATTCTGTACTGGTGTGGATATGGTGACAACATAAACTCCGACATCGCCGAACTGAT
TCAAATAGCCACTAAAAATGGCCGACGAGCCTTTTACATCCCCACTGATGGTTTCGATTCTACGCTCCGGAAAATCACACAGATAG
TGGTCGAGGATGATAACAACCTGAAAAAGAGCTTCTCGAGCTTCACCAGACCAGCAATATCAATGACACTATCACACCTTTTGAT
CTGAAGTGCGAGAGGGTGAATAAGCTGTTGAAGTCAAACATATTCCGGATTAGCTTTCCAGACGAAGTGTTCGTTTTCGATGTGAG
CATCAGCGATAAACCCTGGAAGTTCGTGGACGAAAGGACTCTTGAGCGTTCCACCGCAGCGATATTAGCGCCGTTCCCTATAACAAGCAAATCT
GGGCATTCGGTAGGCTTGACATCATAAAAGACATCTTCAAAGACGTGATGAACTCAGACATTCAGCGAAAACCCCTGGCAAACATC
AAGATATACAACACGGCGGTTAGTCGGCTGTTGCTTACTACGATTTGCAAGATACTGGCGCTGCAGAGCAACCTTAAGACCGACTA
TAAGGGTAAGATATGGACCGAGAACAACAGTAAGTCCATTTCCGGCCACATAGTATACAATGCCGTGCTGCTGTCCTTTGATCGGA
TAAGCGGTGAGTATTACCTTAGCCTCAACCCCGACTTCGTGCTGGCTAACCCCAACATTGAGAAGAGTAGCATACAGACCATAGGA
CTGTTCTTCTTCCAGAAGCTGTGGAATCAGCAGTTTAACGAGTACATTAACTATTGGAAGGGAAATTTTGTTGAAAAGAATAATGA
GTACGAGTTCCCCATAAATAGCGGAACCGGCTTCAAGTTCAAGATCAAGAACATCCCAGTGTTCACTAACATCTGCGACCTGAATA
ACCCTCGCATCAACAATCACAACGTGTCCAGCCACCACCTGCTGCTTCAGGGGGTGCAATTTAAGGAAATCCCGCTGCTTTTCAGC
ACCAACAATGGCAACCGCCACGGCCACCGACACCCCACCCTATGAGAGGACTTCTCATAAACAAACCGTATTGAAACGGGCGTCAACGA
CTTCCTCGAAAAGTCTATCACCCTGGGAATCATAAGCCCCAGTCAGGACGCCCTCAGGTTCTACCAATTCCTGGAAAACCAGAACT
CTAAAATCAAAAAGCACAACGACAAGGACAACTACATAATAGACTACGAAGGGTTTTTCGCCATCTACGGCGTTAGTCTCAGCTTC
CCAACACCTAACGACAACGAGTGGGAAAGGATCAACGAACCGCTGATTATGGGCATCAAGGAGACCGCCCAACAGATAAAGCAACT
GATATGCGACAGCATCGTGAAGATCTCAAGCACGACCAGGAGAAAAATCATCGTCATCTATATCCCCCAACGCTGGGAGCCCTACA
CCTCTTACCAGCTCGATGGTGAGTCATTTGACCTCCATGACTACGTGAAAGCGTTCTGCGCGGAGAAAGGGATTATGAGCCAACTC
ATTCGAGAGAAGACCATTAACGATACTATCCAAAAATGCCAGATACATTGGTGGTTGTCTCTGTCATTTTTCGTAAAATCCTTCCG
GACCCCATGGATTCTCGCAAATACTAACAACACCACCGCCTTCGCGGGTTTGGGGTACAGTGTAGAAAACAAGAAGGATATTAACG
ACATATTGTGCTGGGGTGTAGCCACATTTACAGCTCAAACGGAAGGGCTCAAATACAAGCTGGCCAAAATAAGTAATGATAAG
ATTCAGTGGAGGCATAAGAAGCCGCACCTCTGCTACGACGACGCGTATGAGTTTGGCAAGTCAATTGTGAACCTGTTCTACGAATC
TATGAACGAACTGCCAAAAAGGTGGTCATCCACAAGAGGACCTTCTATACCGATGAAGAGAAACAAGGGATCATAGACTCCATTA
GCGACAATAAGAAAATAGAGAGCATCGACCTCATCGAGATCAACTTTGAAAACAATATAAAGTACGCCTCTAGCAAAATCCACGAC
GGAAAGGTAGACATTGACGGATTTAGCGTATCTAGGGGAACCTGCATACAACTCAGCTCTAAGGAGGCGCTCCTGTGGGCGCATGG
AGTGATTCCTAGCGTCATTAACCTAACTGGAACTTCTACCCTGGCGGCAGGTACATCTAAACCACTTAGGATCATTAAACATT
ACGGTACAGGTAGCTTGGAACAGATCGCGAACGAGATTCTGGGCCTGTGACTAAAATGAATTGGAATAGCCTGAACATGTACAGCCAA
TTGCCTGCCACAATTTCAAGCTCCAATGATATAGCTAGGATAGGTAAATTGATAGGGGCGAACAGTATGCACGAATACGACTACCG
ATACTTCATCTAGTAA |
| 104 | ATGCCTAAGAAGAAAGAAAGGTGGAGGATCAAAGAAAAAACGCAAGGTGGGTAGCGGCAGCATGCCATCAGCCGAGAGGTGCAT
CTGGGAGTGGAAGAGGGAAATCTTCATCACTAAAAACCCCTTGCTCAGGGAAACCGTCGGCGAGCTGTCCCTCCAGGGCACGAAGG
ACCGAATCCAAAATGGCTCGATCAACGCGGCGAATACCCCGCACTGAACTCCCAGAGGAATACTCATTTTATGCCGAGGAGTGC
TACATCACCGAACAAGACAGGCGGAGCTTTTTTCAGCAGTACAGGACGAGGTCGCCAAGCCGCACATAGGTTAGGATTGTTGCCCT
GCTGGCACAGACCAAGATCATAAAAACTGTATGGACGACTAACTTTGACGGGCTTGTCGCCAGGGCCTGTCATTCCAACGACGTGG
TGTGCATCGAAGTCGGTCTCGACAATACCCAACGCATTACGCGCCAGCATTCTGAGGGGGAGCTGCGGGTTGTAAGTCTCCACGGC
GACTACCGATACGATGAGCTTAAGAATACAGATGAGCAGCTCAGGTACCAGGAGGAGGCGCTTAAAAACAATATAGAGCACGAGCT
GCAGGACTACGACCTGGTAGTGATCGGTTACTCCGGCAGGGACCGGAGCCTCATGAACTACACTCGAAAACATATTCAGCAAGGCCG
TGAAGAGCAGGTTGTTTTGGTGTGGCTACGGCGAAACGATAAGCCAGCCCGTTATGGAGTTGTTGGAGCTGGCCCCGCAAGAATAAT
CGAGACGCATTCTATGTCAGCACCGAAGGCTTCGACGACACCGTTGAAAGAATCAGTAGGAAGCTGCTTGACGGCAACATGCTGTC
CAAAGCCTTGGCTGAGATACAGGAGACCACTTGCATCACCAACCAATCTGCCAAATTCACCGCACCTGAAAACGACATCAGCAGCC
TTATTAAGTCAAACGCATACCCCCTCCTGAAGCTCCCGTCTCAGTTCCTTAAAGTGACCCTCAAATACCCGGAGGGGTCCTTTAGT
TACATTGATTGGCTTAACTCCAAGGTTGACTTCAAGGAGGTTGTGTTGTCTAAGATAGCACAGGAGATCATCGCGTTCGCGGATGT
TGATAAGCTGAGGAAGTATCTGGGCGAGTTCACCGTCTACGCCCACGGTGGTGAACTTTAGCAAAACGGACGTGCTTAACGATA
CTCGCATTCAGAGTCTGGTGAGGCGCGGACTTATACAGTCCATCGTAAAAAACCTGAACTGTCCAGCGACCAGAACAAGCGAATA
TGGAATCCAGACGTGAGCTCCATCGAATTCTACAACGGCAAGAAGTACAAAATCATCGACGCGCTCATCCTCAATCTTAGTTTTAT
CAAAGATGACATCTACCTCACGTTCAAACCCGATCTGCTGGTCCTTAACCCTGCAGCACGCTGCAGACAACGATATAGTTAAGA
CTATCAAGAACAAAAAGGTTCGGCTACCAGCACAACAAAGAGTACAGTCAGATCCTGGAGAAGTGGGCCAACCTTATAACGAAGAAG
GATTTGGTCGTGAGTGGCGGGAGCGTGTTCTTCCTTGGGAAGAAACCGCTGTATGCCGGACTTGTGCTTACGCCGCAGGGAAACT
CCCAACAGATTATAACAAGCACGCCACCCAGAAAGGACTGATCATTCAAGACGCGAAACTGATTTTTGCAGCAATTCCATCTCCA
ATGAGATTTCTCACATCAACCCCCTGAAGGGGCTCGTGGAAAATCGCCCGTGGGACTACAAAAACCAGCTCTGGCGTTCGCGCCCC
GAGATCTGCATTAACGTGATCTCAACCAGGCAGGACGCGGGTGTGGTGAGCAACCTTCTCCGAGGTATTCACGAGAAGTCCTTCCC
GGAAAAATCCGAGCAAGATTACTTGCACCCCTTCCATGGGTTCACAAACGCTTTCGGGTGCCCATCACGATCCCTAAGATCGGTG
AGAATACGTGGCGCTTTGTGGACGAAGCACTGAGTGCACAGAAGGCCATCGATAACGCGAAGAACCTCGCGAACCGCATTTGCTAT
GAACTTGACAGCCTGAAGAAGCTTGAACTGCGGACGGGCACCGTCGTGATCATACATCCCCAAGAGATGGAAGCATTGACATC
CATCAAGTCTGAGCATGAGTACTTCGACCTGCATGATTACATCAAGGCCTATGCTGCGCAACAGGGCATTAGTACGCAATTCGTGC |

TABLE 17-continued

Argonaute nucleotide sequences containing 2X Nuclear localization sequence (NLS) from Simian Vacuolating Virus 40

| SEQ ID NO | Sequence |
|---|---|
| | GCGAGAAAACGGTTAATTCAAGCCAAAGCTGCCGGGTAAATGGTGGCTCAGCCTGGCGTTCTACGTGAAGGCTATGCGCACTCCG<br>TGGCGGTTGGAGAGTATTGATAACCAAACGGCTTTCGTGGGGATAGGGTACAGCATCAATCGCAATATGCATCCCGAGAATTCCAA<br>GCGGATAATTCTTGGATGCTCCCACATATACTCCGCCCGAGGCGAAGGCATGCAGTTTCAACTTGGGCGAATTGAAAATCCCATTA<br>TCCACCATCACAATCCCTACATGAGCGAGGAGGACGCTAGACGCACCGGCGAGAAGATACGACAAATGTTTTTTGATGCCAAGATG<br>CAACTGCCACGCAGGGTCGTCATCCACAAGAGGACCGCTTTCACTGAAGAGGAACAGCGGGGGTTCATACAAGGATTGGAAGGCGT<br>TGAGGACATCGAGCTGATCGAAATTAACTTCGAGGACTCCCTCCGCTATTTGTCTAGTAAGTTTGTAAACAGCAAGCTGGAAATCG<br>ACGGGTTCCCCATCGCTCGGGGGACCGTAATCGTGCAAAGCAGCAACACCGCGCTCCTGTGGGTGCATGGTGCAACCCCTAGCGCG<br>CAAAATCCAACGTTTAAGTATTTCCAAGGCAAACGACGGATCCCCGTGCCCCTTGTCATAAAGCGCTACGTGGGGCAGAGCGACAT<br>TAGCCAGTTGGCGAACGAAATATTGGGCCTCAGCAAAATGAACTGGAACACCTTTGACTATTACTCCAGGCTTCCTGTAACCCTTG<br>AGAGCGCCAATGATATTGCCCGGATCGGCGTGTATTTCAACAATTTCTCCCCCATGAGCTACGACTATCGGCTCCTCATATAGTAA |
| 105 | ATGCCCAAGAAAAAGCGAAAAGTGGAAGATCCGAAAAAGAAGAGGAAAGTGGGCAGCGGGTCTATGAATAACGTGATGCAGGAGTT<br>TCCCGTCGCAAGCTTCCCCACATTCTTGTCCGAGATCAGTCTGCTTGACATCACACCGAAGAACTTTATCTGCTTTAGGCTCACCC<br>CCGAAATCGAGCGCAAGACCGGTAACAGTTTTAGCTGGCGCTTCAGCCAAAAATTCCCTGACGCCGTCGTGATTTGGCATAACAAG<br>TTTTTCTGGGTACTCGCTAAGCCCAATAGACCAATGCCCAGCCAGGAGCAGTGGAGAGAAAAGTTGCTGGAAATCTGCGAGGAACT<br>TAAGAAGGACATAGGCGACAGAACCTACGCCATTCAGTGGGTTAGCCAGCCCCAAATAACCCCTGAGATCCTGTCTCAACTCGCCG<br>TCAGAGTGTTGAAGATCAACTGTAGGTTTAGCTCTCCCAGCGTAATTTCTGTCAATCAAGTTGAAGTGAAGAGGGAGATCGACTTT<br>TGGGCCGAAACAATTGAGATTCAGACCCAGATCCAACCCGCTTTGACCATCACCGTGCACAGTTCATTCTTCTATCAACGACACCT<br>GGAAGAGTTCTACAATAATCACCCTTACAGGCAGAACCCCGAGCAACTGCTCATCGGCCTCAAGGTGAGGGACATTGAAAGGAATA<br>GCTTCGCGACGATTACTGACATTGTGGGCACCATAGCGGACCACCGCCAGAAGCTGCTCGAGGATGCCACTGGAGCTATTAGTAAG<br>CAAGCCCTTATAGAGGCCCCAGAAGAGCAGCCCGTGGTCGCCGTACAGTTCGGTAAGAACCAACAACCCTTCTACTACGCAATGGC<br>CGCGTTGCGGCCTTGTATCACCGCCGAGACCGCTAGGAAGTTTGACGTGGACTACGGCAAACTGCTGTCCGCCACCAAGATACCCT<br>ACTTGGAGCGGAAGGAGCTGTTGGCTCTCTACAAAAAGGAGGCGGGTCAATCTCTGGCGACTTATGGTTTCCAATTGAAAATCAGC<br>ATCAACAGCAGGAGGCATCCGGAGCTTTTTTTCAGCCCAAGCGTGAAACTGAGCGAGACCAAACTCGTATTCGGGAAAACCAAAT<br>AGGGGTGCAGGGGCAAATTCTTAGCGGATTGAGCAAGGGTGGGGTGTACAGAAGGCATGAGGACTTCAGCGACCTCTCAAGACCTA<br>TACGCATCGCTGCGCTTAAATTGTGCGACTACCCTGCGAATTCATTTCTGCAAGAGACCCGGCAACGCCTCAAACGGTACGGTTTT<br>GAGACTCTGCTGCCCGTCGAGAATAAGAAAACCCTGCTGGTAGACGATCTGAGCGGGGTCGAAGCACGCGCGAAAGCCGAGGAAGC<br>CGTTGACGAACTGATGGTGAACCACCCCGACATCGTGCTCACTTTCTTGCCGACCAGTGATAGGCACAGCGACAACACGGAAGGCG<br>GCTCATTGTATAGTTGGATTTATTCCCGACTGCTGCGGCGAGGGATTGCTTCACAGGTTATCTACGAGGACACGCTTAAGAGTGTG<br>GAGGCGAAATATCTCCTTAACCAGGTGATCCCCGGAATATTGGCAAAACTCGGCAACCTGCCGTTCGTACTTGCGGAGCCCCTGGG<br>AATCGCTGACTACTTCATAGGCCTGGACATCTCCAGGTCAGCAAAGAAACGGGGGTCTGGAACCATGAATGCCTGTGCCAGCGTTA<br>GGCTGTATGGTAGGAAGGGCGAATTTATCAGGTACAGGCTTGAGGACGCACTGATCGAAGGGGAGGAAATACCTCAGCGCATTCTG<br>GAGAGTTTTCTGCCAGCCGCTCAACTGAAGGGCAAGGTAGTGCTCATTTACAGGGACGGCCGATTCTGTGGTGACGAGGTCCAGCA<br>CTTGAAAGAGAGCAAAGGCTATAGGAAGCGAGTTCATCCTGGTTGAATGCTACAAGAGTGGGATTCCACGACTGTATAACTGGG<br>AAGAAGAAGTCATAAAGGCACCAACTCTGGGACTGGCCCTTAGGTTGAGTGCGAGAGAAGTGATTCTGGTGACAACCGAGCTGAAC<br>AGCGCAAAAATCGGTCTTCCTTTGCCTCTGCGACTCAGAATTCACGAAGCCGGTCACCAAGTATCTCTCGAGTCTTTGGTAGAAGC<br>CACACTGAAGTTGACCCTCCTCCACCACGGCAGCCTGAACGAACCGCGGCTGCCTATACCACTGTTTGGTTCCGATCGAATGGCCT<br>ACCGGAGACTCCAGGGCATATATCCCGGATTGTTGGAGGGGGATCGGCAGTTCTGGCTTTAGTAA |
| 106 | ATGCCTAAGAAAAAGAGAAAGGTAGAAGACCCAAAGAAGAAGCGGAAGGTGGGCTCCGGTTCAATGAACCTGACTCTGTTCAACGA<br>GATCCTCCCCATCAACATCAGCCAACTGCCCAACCAGTACTTCTACAAGCTGTGCACTGCCGGCGACGTGGACCTGGATTCTCTGG<br>GCAGGAGCATCAAGTACCGGATCCAGAATACTTCAGAGGAATCTGGGTGTGGAGTACCAACGACCAACTCCTCATTTCAGACAAG<br>CTCATCGAGTACCCCGAACTGCAAAAGTTCACCCAGTATCTGTGGACCGACCAGTCTAACCTCACATTCAACCAGCTCGAGGGGAT<br>AGAAATCGAG+ACATTAGGTGTTGCACCCCCCAAGGCATCGCTGATTTCTGTAGCCAAGGTCTCATCAAAAAGTACGACCAGCAGA<br>TCAAGAAGATACTCGAACAGTCCAAGACAGCACGGAGAGACTATCATATCAAACTGATCCACAAGTTCGGCTCCTGGGTGGTGAAC<br>AATCAGCCCTGCATAAGCCTGAGCCTGAAACAGGAGATCGATTTTAACGGAACTCTCCAGGACTACCTGACCAAGTTCCCCAACTC<br>TAACATCATCGGCCTGCATGTGCTCGACATCACTAAGCCTTTCAACACCGCACAGGAGGTCATCAAGATTCTCGGTATCTTGGGTG<br>AGGGAAATCGGCGGCAGCGCCTCCTGACTTGGGTCAAGGAGCCAACCATGAAAAACTCGTGGAAGAGGCCCCAGATAGTGAGCTC<br>GTAGTTGAGATCGGGACAAGAAAAAATCCTATCATTACATCATTTCTGCCCTGCGCATCAGATCCTCAACCAAGATTACCTGAG<br>GCTGGGGATTAGCGAGAAGCTGCAAATAGTCAGTGAAGAGAGGTTGAAGTACATCGAGCCACTTTTCCGCATACTGCAATCAGAGG<br>GCTTCCTGGACAAGGTGTATACTAGCCAGCGCAACCCCGAGCTGTTTAGGTCATGCAGCGAGGAATGGGGTTACAATCCCCTGCTG<br>AAGTTCAAGAATAACGCCACTGTTGCGGCGGAATCCGTGCAGTCCAGGTCCAGGTGGTGCAGAAACACGGCGAATTCAGGAAAGC<br>CGACAAAAGCGAAATTAGGATCGCCATACTCAACACACTGAAGAGTGAAAACAGCACCAAATTGATTGAGATTTTCCGAAACAACT<br>TTAAGCGAAGCTTTAACCAGAATTTGGAGGGAATCGGTAATCAGCTTAAGTATAAACTCAAGTTGGTGGGCCAGCCCATTGCACTG<br>GATCTCAGTAAGAACTCCCTCAGCCTGCTGGACAGCAAAATAGGAGAATTGTCTAAAAAGAAGCCGGACATTGTGATCTGTGTGAT<br>CCCTAACTTCCTTAGCAAGGGCGAAGACGGGCGGACACTTTACGACGATTTGAAGCAGACGTTCCTCAAATACAATCTCCAATCAC<br>AAATGTTGCAGGAGAAGACTCTCACGACGTCATTTGCCACAAAGAACATCGTGTTGGGCGTGCTGGCGAAATTGGAAGCGTTCCC<br>TATATTCTGCAAGAACCGCTGACGTACACGGACTTTGTCGTAGGTTTGGACGTGAGCAGGCGACGCAAAAAAAACCTGCAAGGAAC<br>CAACAGCGTAGCCGCCATGACCCGAATCTACAGCAATCAAGGCGAACTGGTCCACTATAGCATCCGAGACGCAACCATCGACGGCG<br>AGATCATTCCCAAGAGGATGCTCTACGACCTCTTTCCACTTCACGAATATCAGGGCAAACGCGTGGTGATTCACCGGGACGGAAAC<br>TTCCCCGAGGAAGAGCGCCAGGCACTCGAGGAAATTGCCGAAAAGATTGCCGAAGGTTCTACTTCGTAAGCATTATCAAATCTGG<br>CAATCCCAGGATCTACGGTAGGACCAAAAACGAAGAGGGCATCGGCAGTTATCGCAAGGCACCTAAGGGTAGCATTTTCCTCCTCA<br>GCGAGACGGAGGCCTTGCTTATCAGCAGCGACTTTCGGACCGCTTCAGGGCCACGCCACAGCCTCTCAGAATTAAGACGTTTGGC<br>AACTTTCCCCTTCAAAGCGCCGTCCATAGCGTTCTGTCACTCACCTACCTGCACTACGGTTCCGAGCGCCCACCGAGGCTGCCGGT<br>GTCTACCTACTACGCAGATAGCATTAGCACTATGGTATCCAAGGGCATTAAGCCCAAGGACGTTGACGGCAATATACCCTTTTGGC<br>TGTAGTAA |
| 107 | ATGCCCAAAAAAAAGAGGAAGGTGGAGGACCCGAAGAAGAAGCGCAAAGTGGGTAGCGGGTCCATGAAAGAGTTTAACGTCATTAC<br>CGAGTTCAAGAACGCAAACAAACAAATCTATTGAGATCTACATCTACAAAATGATGGTCCAGAGAGTTCGAGAAGCGACACAATG<br>AAAATTACGACGTGGTGAAGGAGCTGATTAACCTTAACAACAACTCCACCATAGTGTTCTACGAGCAGTACATCGCCTCCTTTAAG<br>GAGATTGAGAAATGGGGGAACGAGCAATACATAAATGTGGAAGAGGGCTATCAACCTGGAGTCCAACGAGAAGAAATTCTGGA<br>GAGGCTCCTGCTGAAGGAAATCAAAAATAACATAGACAATAACAAGTACAAGGTCGTCAAGGACAGCATATACATCAATAAGCCAG<br>TGTACAACGAGAAGGGCATCAAAATTGACAGGTATTTCAATCTGGACATAAACGTTGAGTCAAACGGAGACATTATCATCGGGTTT<br>GACATCTCCCATAACTTCGAGTATATCAACACTCTGGAGTATGAAATAAAGAACAATAATATCAAGATTGGGGACCGGGTAAAGGA |

TABLE 17-continued

Argonaute nucleotide sequences containing 2X Nuclear localization sequence (NLS) from Simian Vacuolating Virus 40

| SEQ ID NO | Sequence |
|---|---|
|  | CTACTTCTACAACCTGACCTATGAGTACGTGGGCATCGCCCCCTTTACTATCTCCGAGGAAAACGAGTACATGGGCTGCTCAATCG<br>TCGACTATTATGAGAACAAGAACCAGAGCTATATTGTGAATAAACTGCCTAAAGACATGAAGGCCATCCTGGTAAAGAATAATAAG<br>AACTCTATATTTCCCTACATCCCGAGCAGGCTTAAAAAGGTGTGCAGATTCGAAAACCTTCCCCAGAACGTGCTGAGGGACTTTAA<br>CACGAGGGTGAAGCAGAAGACAAACGAAAAAATGCAGTTCATGGTTGACGAAGTGATCAACATCGTGAAGAATTCCGAGCATATCG<br>ACGTCAAAAAGAAAAACATGATGTGCGATAACATTGGGTACAAGATCGAGGACCTGCAACAGCCCGACCTGCTCTTCGGTAACGCC<br>AGGGCCCAGAGGTACCCCCTCTATGGTCTCAAAAACTTCGGGGTGTACGAAAACAAGCGGATAGAGATCAAATACTTCATAGACCC<br>CATCCTCGCCAAGTCAAAGATGAACTTGGAGAAAATCTCCAAATTTTGTGACGAGCTGGAACAGTTTAGCAGCAAGCTGGGCGTGG<br>GGCTCAACCGGGTTAAGCTGAACAACATAGTTAATTTCAAAGAAATCCGCATGGACAATGAGGACATTTTCAGCTACGAGATAAGA<br>AAGATAGTGAGCAACTATAATGAAACTACCATCGTAATCCTGAGCGAGGAGAACCTGAATAAGTACTACAACATCATTAAGAAAAC<br>ATTCAGCGGCGGAAACGAGGTGCCCACCCAGTGCATCGGTTTCAATACGCTGAGCTACACGGAAAAAAACAAAGATTCTATCTTCC<br>TGAACATTCTGCTGGGGGTTTACGCCAAGAGTGGCATCCAGCCCTGGATCCTGAATGAGAAGTTGAACAGTGACTGCTTTATCGGC<br>CTGGACGTGTCTAGGGAGAATAAGGTCAATAAAGCGGGAGTCATCCAGGTGGTCGGGAAAGACGGCAGGGTGCTCAAAACTAAGGT<br>GATCAGCAGCAGCCAAAGCGGAGAGAAGATCAAGTTGGAGACCCTCAGGGAGATCGTGTTTGAGGCAATCAACAGTTACGAGAATA<br>CGTACCGGTGCAAACCCAAACACATTACTTTCCACCGCGATGGAATCAACCGCGAGGAACTGGAGAACTTGAAGAACACCATGACC<br>AACCTCGGTGTTGAGTTCGACTACATCGAAATTACCAAAGGCATTACAAGGGGATCGCCACTATCGCGAGGTGAGGAATGGAA<br>GACGATTATGGGGAGGTGCTACTATAAGGACAACAGCGCGTACGTGTGTACCACCAAGCCTTACGAGGGAATCGGCATGGCCAAGC<br>CCATCCGAATCAGGAGGTGTTCGGCACGCTCGACATAGAAAGATTGTCGAAGACGCCTACAAACTGACCTTTATGCACGTTGGC<br>GCAATTAACAAAATCAGGCTTCCCATTACTACGTACTACGCAGACCTGAGCTCCACTTACGGCAATCGGGATCTTATCCCCACAAA<br>CATCGACACTAACTGTCTGTACTTTATATAGTAA |
| 108 | ATGCCTAAGAAAAAAGGAAAGTGGAGGACCCAAAGAAGAAGCGGAAGGTGGGCAGCGGTAGCATGCAAGGCACTATATCCATAAA<br>CGAGGTGAGGATCCAGCTTAATACTATTAAGAATCTTTCAGTGTTCAAGTGCAGCCTCAGCGGAATTAGCACCCGCCATAAGAACC<br>AGATCGAGTTCATCCTTCGCAGCGAGCAAAACGAGTTAGCATCTTTGAGGGTGAAGTGATCTTTGCGCTTCCCGTCGAACAGCAG<br>AACCTCGAAAGAGATAAGCAGGCTCTGTTCAGCTTCCTGGTCAAACAACAAAGGATCTCAATCTGAAACAGCTGAGCCTGGTGCC<br>CCTGAGGGAGGTGCCCGAGCGCGTTATCGAGCGACTGACTTTCGCAATGGTTAGCTATCAGGCCATGAAGCAGGGCATCTTCTCTA<br>TCTATGGTCATACATTTTTTCGCCCCACCCTTATGACGGATAGGCTTGCGCACAAGGCGGTGGAAGTCACGACGTGCATCGAGGAT<br>GGCTTCCTCAAGTTTTATCTGGACCCGACGTACATTGCACTGACATGCATAACGGACACAGCACGCGAAAATAGGGAGAACCTGGA<br>ACTGGTCGGGCTCTGCTCTTTCCGCAACAAAAACCTTTGTAGCCTTGTCAGGCCGGACGGCTCATGCAACTGCCTCATACCTGGTA<br>AGTTGGGGTATTACGTCCAGGAGATGGGGATTAAGGACGTTGAGGATGATAGCAAGGACTTTCTGGCCAAACGGTTCAATAGCTGT<br>CCCCGGTTTAGTGAGCACACGCGCTTTATACAAGTGAAGGCGAGTAAAAGAGGCACGAAGTACTCCCTGTTCCCTTCTTACGTAGT<br>TTTTAGCAGGTTGTCCCGAATGGACCTGTCCGCTAAGCCAGATGTGCGGTCCAGTTATCGGAAGGCCACATTGATGGACTCTCACG<br>AAAGGCTTAACTTGACCAACGACTGGATAAGACAAATTTTCATGATCGGGCAGAAGGGCCTTCAAAATTGGGGTGTTATAAAGGTC<br>AACCAGACCGAGATTCCCGTTGAAATTGTACTCACAATTGCCCACGCCATCGCGCCCAAGCATTCTCAAGGCATCTATAAGGCTAT<br>ATTCCTCCCGGACCAGCAAATTACGAATGACAGCAATAACCCAACGCCTCAAACGCTGAGCGGGGGTTGGCTCTTCACGAATAGGG<br>GTGCGTTCGACAGGAGGGATCCTAATAGGCCTTTTAAAGTAATCAGCCCCTACATCATCGTGCCCAACAATGAGCAAAGCATCAGC<br>TCTTGCCGCCAGCTGATCAACTACTTCAGCAACGGCAGGTACAAGGCCCGGTGCAAGGGTGACAGAGACTTTATTGGTATTTCATT<br>GCCCGAAAACAAGGGCAAGTACAACACATCATTTGTCAATGCTTTCGAAGAGGAGGACGGCCTGTATTTCGTTGAAGAGACGATAC<br>AGGGCTACCAGAAGGCGCTGCAAGACATTGTTAGAGACTGGAATATCACGTCCAAGCGGGACATCAATAAACACGCTATAGTGATC<br>ATACCGGGCGAGAACGATATTGACGACAATCCTTTCTATTATCAACTGAAAAAGGCGTTCGTAGAGGAAGGGATTCCCAGCACCTT<br>CATCACGTACGAGACTATGAACAAAATCAACGACCCCGACATCATGTCGGGCCAATCATGGACAGCCTGTGGTTGAACATTTACA<br>GCAAAATGGGGGGCAAACCGTGGCGCCTCGCTAATAGCCTCGGCAACGTGCACTGCTTTATCGGTATTGGGTTTGGAATTAACCCC<br>GAGACCACCGGAAACCACATATTCGCAGGGATCGCCCACATCTTCGACAACTACGGGAGTTGGATAGACGTAGCGAGTGATTCCGC<br>CAACCTCTCCCAAAACGATCTGAACTCATTCGAGGGCACGGAAAAGTACACACAGGGGAGTGCTAGCTTTAAGATCAGTCAGAGCG<br>TGTCCCAGTCCATTGTGTATAACGACATTGAAGCTGTACCAACAGAAGCAAACTAAGACCCACGAAAACGCCCACAAACATCGTCCTG<br>CACAAACTGGGCCAGATCTACGAGTGTGAGGTCATCGGGTTCCTCGAAGGAATTCGCCAAGTGCTCGGGAGTCTGGGCGACTGCAA<br>GCTGGGATTGCTGCAAATTGAGCAGGAGCACCACCTGCGCCTCTATGGCGCAGCAGCCCAAACCGGCAAGGAGAACAACACGATCT<br>TTCGCGGTTCAGCACTTCAACTCAACCCGGAGAAGCTGGTTATCGCGTCCACTGGCCGCTCTTACCGGCAGACGAGCTCCGGGCTG<br>TTTATGAATTATCCGGCATCGGCACCCCCCAGCCGCTCCTGTTGACTTCTATCGTACCGAATCAGCAGATCCTGCAGAAGTACGG<br>CTGTAACGCAAACCAATTCTACTCAAGCGAGGACCTGGCGAAACATGCAATGGCCCTGACGCAACTTCACTGGGGGTCACTGAAGG<br>ATAATGTAAGATTGCCGATTACCACGCTTTACGCGCAAAAGGTCGCCGACTTGATTAGCAAGACCAACATGCGGATCAATCCAGGC<br>TTGGGCTACTTCCGACCCTGGTTTCTTTAGTAA |
| 109 | ATGCCGAAGAAAAAGCGAAAGGTGGAAGACCCAAAGAAGAAACGCAAGGTGGGCTCCGGCAGCATGAATAACCTGACACTGGAGGC<br>CTTTCGGGGCATTGGCACCATCAAGCCACTGTTGTTCTATCGGTACAAGCTGATCGGCAAAGGGAAAATAGAGAATACCTATAAGA<br>CGATACGCAACGCACAGAATCGGATGTCTTTCAACAATAAGTTTAAGGCCACCTTCAGTAAGGATGAAATCATATACACCCTGGAG<br>AAGTTCGAGATTATCCCGACGCTGGATGATGTGACGATCATCTTCGACGGGGAAGAAGTGCTTCCTATAAAGGACAACAACAAGAT<br>TTACAGCGAGGTAATAGAATTTTACATTAACAACAATCTCCGGAACGTTAAGTTCAACTATAAGTACCCGAAGTACAGGGCTGCCA<br>ATACAAGGGAGATCACGGGCAACGTGATCCTCGACAAAGATATGAACGAAAAGTACAAGAAGAGCAACAAAGGCTTCGAACTCAAA<br>CGGAAGTTCATAATCAGCCCCAAGGTCGACGATGAGGGTAAGGTCACATTGTTCCTGGACCTGAACGCGTCATTTGACTACGACAA<br>GAACATCTACCAGATGATAAAGGCCGGAATAGATGTGGTAGGAGAGGAGGTCATCAACATCTGGAGCAATAAGAAGCAGCGCGGTA<br>AGATCAAGGAAATCAGCGACATTAAGATAAACACAAACCCTGCAATTTCGGCCAGACGCTGATAGATTACTATATAAGCAGCAATCAG<br>GCGTCACGGGTGAATGGATTTACGGAGGAAGAGAAGAACACAAACGTCATCATCGTGAAAGCGGCAAAAGCCGCCTGTCATACAT<br>ACCGCACGCGCTCAAGCCTATCATAACGCGAGAGTACATCGCCAAGAACGACGAAGTCTTTAGCAAGGAGATAGAAGGGCTCATCA<br>AAATCAATATGAATTACAGGTACGAGATTCTCAAGAGGTTCGTCTCCGACATCGGCACTATTAAGAACTGAACAACCTGCGCTTC<br>GAGAAAATCTATATGGACAATATAGAAAGCCTGGGTTACGAGCAGGGTCAACTCAAGGACCCCGTGCTCATCGGCGGCAAGGGTAT<br>ACTTAAAGACAAAATACATGTCTTCAAGAGCGGCTTCTACAAATCCCCAATGACGAAATTAAGTTTGGCGTGATATACCCGAGAG<br>GCTACATAAAAGATACCCAGAGCGTTATCCGAGCCATCTACGACTTTTGCACCGAGGGCAAGTACCAGGGAAGGATAACATATTC<br>ATCAATAACAAGCTCATGAACATCAAGTTCTCCAATAAGGAGTGCGTCTTTGAAGAGTACGAGCTCAATGACATAACCGAGTATAA<br>GCGGGCTGCAAATAAGCTCAAAAAGAATGAGAACAAATAAAGTTCGTGATCGCAATCATCCCCACTATCAATGAAAGTGACATTGAGA<br>ACCCCTACAACCCCTTCAAAGGGTCTGTGCCGAGATCAACCTCCCAGCCAATGATCAGTCTCAAAACTGCAAAGCGGTTCAGC<br>ACCAGCAGGGGCCAATCTGAGTTGTATTTCCTGCATAACATCAGCCTCGGCATTTTGGGCAAAATAGGCGGCGTACCCTGGGTAAT<br>TAAGGACATGCCAGGCGAGGTCGATTGTTTTGTGGGCCTGGACGTGGGCACAAAAGAGAAAGGAATCCACTACCCCGCATGCAGCG<br>TGCTGTTCGACAAGTATGGCAAACTCATTAACTACTACAAGCCGACGATCCCGCAGAGTGGAGAGATCATTAAAACAGACGTGCTG<br>CAGGAGATCTTTGACAAGGTTCTGCTGAGCTACGAGGAGGAGAACGGCCAGTATCCCCGCAACATCGTGATACACAGGGACGGCTT |

TABLE 17-continued

Argonaute nucleotide sequences containing 2X Nuclear localization sequence (NLS) from Simian Vacuolating Virus 40

| SEQ ID NO | Sequence |
|---|---|
| | CAGCCGGGAGGACCTGGAGTGGTATAAGAACTACTTCCTGAAAAAAAACATCGAATTCAGCATAGTAGAGGTCCGCAAGAACTTTG<br>CCACGCGACTTGTAAACAACTTCAACGATGAAGTGTCCAACCCAAGCAAAGGTTCATTCATTTTGAGGGACAACGAAGCGATTGTC<br>GTCACGACGGATATTAACGACAACATGGGAGCGCCCAAACCGATCAAAGTTGAGAAAACGTATGGCGATATTGACATGCTCACAAT<br>TATCAACCAAATTTACGCACTGACACAGATTCACGTGGGGTCCGCGAAATCCCTTAGACTGCCTATAACCACGGGCTACGCCGATA<br>AGATCTGCAAGGCTATCGATTACATCCCGAGCGGCCAAGTCGATAACAGGCTGTTCTTTCTGTAGTAA |
| 110 | ATGCCCAAGAAAAAGAGAAAGGTCGAGGACCCGAAGAAGAAAAGGAAAGTGGGCAGCGGCAGCCTGAAAATCAAAATTCTCAAGGA<br>GCCGATGCTGGAGTTTGGCAACGGCGCTCACATATGCCCCAGGACCGGTATCGAAACCCTGGGAGTGTACGATAAGAGAGATGAAC<br>TGAGGAGGAGCGAGCTGCGAATAGGCATTGTGGGTCGGGGCGAGGGCGTGGACCTTCTGGATGAGTGGCTCGACAAGTGCAAGCGC<br>GGCATCGTGGGTAAAGAGGAGACCAAGTTCCCCAACTTGTTCAGGGGCTTTGGGGGCGTCGATGAGTACCACGGTTTCTACACCAA<br>GATTCTGAGCGACCCCCAGTATACCCGGACTTTGCAGAAGACGGAGATTAACAACATCAGCAAGATCACCGCCCGAGAGGACAGGG<br>TAGTGAAGTGCGTGGAGCTGTACTACGAGCAGATCCGATTCCTGTCAGAGAACAGGAGCATTGACGTGATCGTGTGCGTCGTTCCC<br>AATGATATTTTCGACAGCCTTACTAAGGCCACCGGAGACAAAGACACCGAGTCCCTGGAGGCCTACCTCGAGCAACTTTAGACG<br>GTTGCTCAAGGCCCGCTGTATGCACCTTGGGATACCCTTGCAGCTTGTGAGGGAGAAGACCATCCTGAGCGTGAAGCCTAGCATAG<br>ACCAGCAGGACCTTGCCACAAAGGCTTGGAACTTCTGTACGGCCCTCTATTACAAGGGGAATAGGACTGTACCATGGCGCCTGGTG<br>GAGGATAAATTCAAGCCTAAGACCTGCTACATCGGCATTGGGTTCTATAAGAGTAGAACGGCGAAACGGTGAGCACATCACTTGC<br>ACAGGTATTCGACGAGTTCGGCCACGGGTCATCCTTCGGGGAGCACCAGTTAGCCTGGACAAACGAGACAAGAGGCCCTACATGG<br>ACGAGTCTCAGGCTTACGAACTGCTGGACAGTGCCCTGGCGGAGTACGAGAAGGCCCTGATGCAAAAGCCCGCTCGAGTGGTGATC<br>CACAAGAGCAGCAGGTTCCGGCCCACCGAGGTGAGCGGCTTCAGCAGAGTGCTGAACGCGAAAGGAATCAGAACGAAGGACCTCGT<br>GAGCATCACATCAACCGACATCCGCCTGTTCAGCGACAAAACTATCCCCCCACCCGCGGTACCTTGTTGTCCCTGTCTGAAACAC<br>AAGGAGTACTGTATACCAAGGGAATCGTAGATTTTTACAAGACCTATCCGGCATGTATATCCCTTCACCCCTGAGGGTTGAGGCG<br>TTCGAGTCCGACAGCTCTCTTGAAGACTTGTGTAAGGAAATCCTGGGCCTGACCAAAATGAATTGGAACAACACACAACTGGACGG<br>CCGACTGCCCATTACCCTGGAATGCGTCAATAAGGTGGGCGATATCATGAAGTATGTGGACGCATCCGAAAAGCCACAGGTTGGTG<br>TGGCGCTGTTTATCTTCATGTTGGAGCAACTCGTACCCGGCTGGAAGCTGCCTAAGGTGAGTACATGGGTAGCACGGGTAATTTTC<br>CTGAATATTGTACAGGTGTCTATCGCTCTGCTTGCCGGGATTACTTGGAATAAATGGATGATGGGCCACAGTTTGTTGCATACCAG<br>CGATGCCCTGCCCCCCTTGCTCGCAGGATTCGCCGCCTACTTCGTTAACACCTTCGTGACCTACTGGTGGCACAGGGCCAGGCACG<br>CCAACGACACCCTTTGGCGACTTTTTCACCAACTGCACCATGCGCCCAGAGGATCGAGGTGTTTACTAGCTTCTACAAACACCCA<br>ACGGAAATGGTATTCAACTCTCTTCTTGGCAGTTTCGTGGCCTACGTCGTTATGGGGATCTCCATCGAAGCTGGCGCGTATTACAT<br>CATGTTTGCGGCTCTTGGCGAGATGTTCTACCACAGCAACTTGCGAACACCGCATGTTCTCGGTTATCTCTTTCAACGCCCTGAGA<br>TGCACCGGATCCACCACCAGAGGGACCGACACGAGTGCAACTACAGCGATTTCCCCATCTGGGACATGCTCTTCGGCACCTACGAA<br>AATCCCAGGAGAATAGACGAACCACAGGGGTTTGCCGGCGACAAGGAACAGCAATTCGTTGATATGCTTTTGTTTAGGGACGTGCA<br>TTCCCTCCCCGGGAAGACACAACCAGCTCCCGTACTCGTCAAACCCGACGTGAGGTAGTAA |
| 111 | ATGCCGAAAAAGAAGCGGAAAGTAGAGGACCCGAAGAAAAACGCAAGGTGGGCTCCGGGTCTATGGCCAACCATACCTTTAACAT<br>CCTGACTTTCAACCACCCCCAGGAGGAACAGACCTTCTACTTCACGGACCAGGAGCAAGACAACCTGACCCGCATCTACAAGAGCC<br>TGGTGCCCGACGAGGTCATCGAGAAATATGGCGAGCAGGATCACTACTACACCTCTTTCACCGTAGAGAAGGATGGTTTCCTGGCG<br>GTCAGCAAGCCCACAACGCCCCTGTTCGAGACCAAGACTACGGAGGCGGGCGAGGAGAGGACGTATACCATCAGGAATTCAACGTT<br>CAGCAGCAGCGTGTTGAAACGGTACTACAACAGCCTTATCCACAGCCACTTCAAGGAGAAGGGCTTCCTGGTGAAGCCCAACTTCG<br>TGAGCGACACGGAGGTGTGGCTGCCTAGCGCCAAGCAGGACACGACCGGCAAATACAAAATATTCGACCGCTTTAGCCTGAAGGTG<br>CAGTTCAAGACCGTCTCTGATTCCCTGGAGTTGCTCGTCACGTTCGAGGGGAAGTCAAAGATATTCAAAGTACCTGTTAGCACCCT<br>GCTGGAGGATGTGAGCCCCACGGACATCAACTGGGTTGTGTACGAAAAGGGGATTGTACAGGTTCGACGAACTCCCGGACAGCGGCA<br>AGAGGGAGTATGACAAGGTTTACCCCGTGTGGACCTTCGAGATCAGGGACGCGCTTATGCAGGGCACCGAAGCCCCAGACAAGACC<br>AACAAGTACAAAAAGTTCAGGGAGGGCATCGACAAGTTCTATAACCAGTATCTGAACACAGAGGAGTTCAAAGCCATCATTCCAAT<br>CACGTCTAATGGCTTCATCCCGGTCAATAAGATCAATGTCGGTAGTGTGAATAATAGTAGCAACAGGCTGCTGTTCGGGGAACAAA<br>AGAGCGGTATCGTGCCAATGGACGGCATGAAGGAACATGGCCCATTCGACTTTTCCAGCACCAGCAAGATCCATTTCTTCTTTATC<br>TTTCATAAAGCGACCAGCACATCGCCCAAAAGATGGATGGCTATTTCAAAGGCAGCGAGTTCGGGTTCAAGGGACTCACCAAATT<br>CATACACACCCCCTATCACACCGAGAAAGGATTCTCAATCAGGTTTGAGGACCGCGACAATCCGTGGCCCGAGATCTACGAAGCCG<br>TCACTAACAAGCACTTCGAGTCCGACATACAATACATTGCGATCTACATCAGCCCCTTCAGCAAAAACAGCCCCGACAAGAGTCGG<br>CGCAAAATCTATTACAAGCTCAAAGAACTGCTCTTGAAAGAAGGCGTGAGCAGCCAGGTGATTGACGGCGAGAAGGTGATGACCAA<br>CGAGAAGTATTACTACAGCCTCCCAACATAGCAATCGCCATTCTGGCCAAGTTGAATGGCACCCCTTGGAAACTGGACACCAAGC<br>TGAAGAACGAACTGATCGTGGGAATCGGCGCCTTCCGCAACAGCGAGGTTGACATTCAATATATCGGCAGCGCGTTCTCTTTCGCA<br>AACAACGGCAAGTTTAATCGCTTTGAGTGCTTCCAGAAGGACCAGATCTATAAGATGGACAACGAACCTTTTCCGGTTGGCTAACGAGCAAA<br>GTACGCCAACGTAAACACCGGCATTAAGAGGCTTGTGATCCACTTTTACAAAAGCATGCAGCAGGATGAGCTCCAGCCGATCGAGG<br>ACGGCCTTAAAGACCTCGGCCTGGACATTCCGGTATTCATCGTATCTATCAATAAAACAGAAAGCAGTGATATCGTGGCGTTCGAT<br>AACAGCTGGAAGGATCTGATGCCGATGAGCGGCACATTCATTAAAGTGGGGTACAACAAATTTCTCCTGTTCAACAACACCAGGTA<br>TAATCCAAAGTTTTACAGCTTCCACGACGGGTTCCCCTTCCCCATCAAACTTAAGATTTTTTGCACTGAAAAGGAACTCGTGGAGG<br>AGTATAAAACGGTTAAAGAGCTGATCGACCAGGTGTACCAATTTAGCCGCATGTACTGGAAGTCTGTCCGCCAGCAGAACCTGCCC<br>GTGACCATTAAGTATCCGGAAATGGTGGCCGAAATGTTGCCTCACTTTGACGGGAATGAGATACCTGAATTCGGTAAGGACAACTT<br>GTGGTTCCTGTAGTAA |
| 112 | ATGCCCAAGAAAAAGCGAAAGTAGAGGATCCAAAGAAGAAACGGAAGGTCGGCAGCGGAAGTGTGAACCATTACTATTTTTCCGA<br>ATGCAAGGCGGACGAGAAAGCCAGCGACATAGCCATCCACCTTTACACCGTGCCCCTGTCCAACCCCATGAGAAATACAGCTATG<br>CGCACAGCATCGCCTATGAATTGAGAAAACTCAACTCATACATAACCGTGGCCGCGCACGGTCAGTACATCGCGTCTTTCGAGGAG<br>ATATGCCACTGGGGCGACCACAGGTACATACAGCACGAACATAGACCAATCCAGTGCAGCCTCCCGATGGAGAGGACCATACTGGA<br>AAGACTCCTCAAGAAAGAGCTCGAGAATAGGTGCAAAAGCAGCTATAAGATGGACAACGACCTTTTCCGGTTGGCTAACGAGCAAA<br>GCATGCACGTGGGCGAGATCAGCATACACCCCAGCGATCTACATCTCATTCAGCTGGAGGAAAATGGTGACATATTCGTTGGCTTC<br>GACTACCAGCACCGGTTCGAGTACCGCAAAACACTCCAAGACGTCATCAACAACGATCCCTCCCTGCTTAAGGAAGGCATGGAAGT<br>GGTGGACCCCTTCAATAGAAGGGCCTACTATTACACTTTTGTGGGCATGGCCGATTATACCGCCGGACAGAAAAGCCCCTTCCTGC<br>AGCAGTTCTGTGATCGACTATTATCTCGAAAAGAATGAGCTGTGGAAGCTCAAGGGTGTGCAGAAAAACCCCCGTGGTGCACGTC<br>AAGAGCCGAGACGGTCACTTGCTCCCGTATCTGCCGCACCTGCTCAAATTGACATGTTCATACGAACAGCTCTTGCCCAGCATGAC<br>CAAGGAAGTCAATCGCCTGATTAAGCTGAGCCCAACGAGAAGATGAGTAAGTTGTATACGGAGATGTTCGATTGCTCCGGCAGC<br>AACAGGTGCTGACCTTCAAGAAGGAAAACGTGCGAGCCGTCAACCTCGGCTACGATGTGAATGAACTTGACAGCCCGATCATGGAG<br>TTCGGACAAGGCTACAAGACAAACGAGATCTATCGAGGCCTGAAGCAGAGCGGAGTATACGAGCCCAGCTCAGTGGCCGTGAGCTT<br>TTTTGTTGACCCCGAGCTTAACTACGACCCCCAGAAGCGGAAAGAAGTAGGTTGCTTCGTCAAAAAACTGGAGAGCATGAGCGAGG |

TABLE 17-continued

Argonaute nucleotide sequences containing 2X Nuclear localization sequence (NLS) from Simian Vacuolating Virus 40

| SEQ ID NO | Sequence |
|---|---|
|  | CCCTGGGAGTAAAACTGAACATAAGCGACCAGCCCCGACAACTTTATGGCCAGCTCCCCAAGGACTTTTTCAAGCAGGACAACCTC<br>TCATATCATTTGAAATCTATCACCGACCAGTTCAGGGGAACGGTGGTGGTTGTTATCGGCACTGAAGAGAACATCGACCGGGCATA<br>CGTTACAATCAAAAAGGAATTCGGCGGCAAGGAGGATCTGATGACCCAGTTTGTCGGCTTCACCTCCTCCCTCGTCACGGAGAACA<br>ACATTTTTCACTACTACAACATCCTGCTCGGCATCTATGCGAAAGCTGGTGTTCAGCCCTGGATACTCGCCAGCCCAATGCACTCA<br>GACTGTTTCATTGGACTCGACGTAAGCCACGAGCACGGTAAGCACGCATCAGGGATAATACAAGTGATTGGACGGGACGGCAAGAT<br>TATCAAACAAAAGAGCGTTGCGACAGCAGAGGCCGGAGAGACTATTGCCAATAGCACGATGGAAGAAATCGTCAACGAAAGCATTT<br>ATTCCTACGAGCAGATCTACGGGGCCAAACCGCGCCACATAACATTCCATAGAGACGGGATCTGTCGCGAGGACCTCGATTTTCTG<br>CAAGCGTATTTGCGGAGTTTCCAAATCCCATTCGACTTCGTAGAAATCATAAAGAAGCCGCGACGCAGAATGGCGATATACTCTAA<br>TAAGAAGTGGGTCACGAAACAGGGAATATACTACAGTAAGGGCAACACCGCTTATCTGTGTGCCACGGACCCCAGAGAATCCGTGG<br>GTATGGCGCAACTTGTCAAGATCGTACAGAAGACTAACGGATTGAGCGTTCACGAGATAGTGAGCGACGTGTATAAGCTGTCCTTC<br>ATGCACATACACAGTATGCTCAAGACCAGGTTGCCTATCACGATACACTATAGCGACCTCAGCTCAACGTTCCACAACCGGGCTT<br>GATCCATCCCCGGTCCCAACATGAGAGAGCACTCCCGTTCGTGTAGTAA |
| 113 | ATGCCTAAAAAGAAGAGGAAAGTAGAAGATCCAAAGAAAAAGCGAAAGGTGGGAAGCGGCAGCATGACCGGCGAGACTAAAGTGTT<br>GGTCGGGAGGCAACCCTTCGACGTGGATCGGCTGAATGAACTCAGGAACGAATTCCGGGAGACGCACGTGTTCAGAAGGGATGGCA<br>TCGACGATGTCATTGTTGATGTTCCGGTCGTGGCCGGACAGAAGCCCATCGGCAACGTCCAGGAGGAAATAGACCTGGCTAGGTAC<br>CAAAAGGTGTGGCCCTCCCTCCTCAGTGCTGCTCTTGTCCGGGCGTTTAGCGGCGTAAGGGACATCCTGAGCGATAGGCCCGTGAG<br>CGTGGTGGGGAGCACACTGCGGGGTCTGGTTCAACATCCGGAACTCCCCGAATGGATGCAGAAACGCACACTCCTTAGGTTCGACA<br>CCCGGACCCATCTATGCTGGTGATAAAAGAACCTTTGGCTTGGTGTGCGAGGCCAGATTGAAAAACCTTATCCAAGGTAGTTGCGCG<br>GAGCTGCTGGCACTTGGAGTTTTCCCCACTGGGTCGATATGTCCAAGTCGAGGAGCCACATTACGATCCCAGGCTTATGAAAAACG<br>GCGCCTTGTGGGCAGGGTATCAGCGATCTCCGGCGATAATCTGGTGCTGGAGGACCATGCCGAGGGCTTTCCGACCGTGAGTGCAA<br>AGCTGGCATTTCTGGAGGCGCGAAGGGAGATTTTTGACGACTGTGTGCGGAGGATTTTGAACTCTGATGCGGCCTCCGTGCTGAAC<br>AAGGCCGAAGCTACTGCTGCCTCATTTCACTCAGGGCCAGGTAGGAAAGAGCAAATAGAGGAGGCTCTCAAGTATCTCAGGGAGAA<br>GGTGAGCCTCGAAGCTGTACCCGGAGCGAAATTCGTGATCGGGCCGATGCTGAGTAGCGGCAACAAGGGCTTCCCCATCACGGAGA<br>TGATCCCGAAACCCATTCTCGTGTTCGATCCGAGCGGTACACGGAAGGATGAGTGGAACGAAAGGGGCATTAAGAAGAACGGGCCC<br>TACGACCAGAGGACGTTTTCACCTAAGCAGTTGAAGGTGGCGGTCATTTGCCAGGCGAAGCACGAGGGGCAGGTGGATGGATTCAT<br>CGCGAAGTTCTTGGAAGGTATGCCAGACGTTATGACGGGCAAGAACCGAGTTGCTAGATATGGTGACGGTTTTCTGCGGCGATTCG<br>CCCTTGAGAAACCTTCTGTGACCTTCTTCACAGCGCCCTCAGCCAAGGCGAGCGATTACCTGGTGGCCAGCCGGGCTGCGCTGACC<br>AAGGCAACGGACGAGGGTTTCAAATGGGACCTCGCGCTTGTGCAAGTGGAGGAGGAGTTTAAGGGATTCGACGACGAGAGCAACCC<br>CTACTATGCCACTAAATCCGTCTTCCTGAAGCGAGACGTGCCGGTCCAAAGTGTACGACTCGAAACCATGGCTCAGGCCGACAGCC<br>AGCTGATTTTCTCTATGAACCACATGAGCCTGGCGACATACGCCAAGCTCGGTGGTACCCCTGGCTTTTGGCGTCACAGCAGACG<br>GTAGCGCATGAACTGGTTATCGGTCTTGGCAGCCACAGCGTGGCCAACAGCAGGATCGGTAGCCAGCAACGATTCGTCGGGATTAC<br>GACGGTGTTCTCCTCCGACGGGAGCTATCTGCTCTCAGACCGCACGCGGTTGTCCCCTATGAGGAGTATGCGACTGCGCTTTACG<br>ATACGCTCAAACGGAGCATCACTACGGTGAGGAAACAAGACAACTGGAGGTCTACGGATAAAGTCCGCCTGGTGTTCCACATGTTC<br>AAGCCCCCCAAGGACACCGAGGCCGAGGCTATAAAACGGACAGTGGACGATCTGGAGCTGGAGAACGTGACTTTCGCCTTCGTGCA<br>CATCGCCCCATCTCATCCCTACCTCATCTTCGACAATACACAAAAGGGAATTGGTTTCCGAGACCCCAAGAAGGGGATACTCGGAC<br>CCGAGAGAGGTCTGCACTTGAAGCTGGGGGACTACGAGTCCTTGATCGTATTCAGCGGCGCAAGCGAGCTGAAACAGGCAAGTGAC<br>GGGATGCCCAGGCCATGCCTGCTCAAGTTGCACCGGCTTAGCACGTTCACTGACATGACGTATCTGGCGCGACAGGCATTCGAGTT<br>TTCAGGTCATTCATGGCGAATGCTCTCCCCAGAACCGTTCCCTATAACTATTAGGTACTCCGACCTGATCGCCGAAAGGCTCGCAG<br>GTCTCAACGCCGTCCCGGGTTGGGACGCGGAGGCTGTCAGATTCGGCCAAATCGGCCGCACGCTCTGGTTTCTGTAGTAA |
| 114 | ATGCCCAAAAAGAAACGGAAGGTGGAGGACCCGAAGAAAAAGCGCAAAGTAGGGTAGCGGCAGTATGCGATTGGGGCACATAGGCAA<br>CGGCTGTTACAGGGAAGGCGTTAAAGCACAATTCCAGACACGAGAGAGGGAGGATGCCGGTTCAAGGGCTGCGGCTGCCCAACCCC<br>CGATTAAGCAATTCGGATACACCGATAGACTCGGCCTGAACCTCGCCCCCATAAGGTTTTCTAGCGAAGAGTTTGAAGCCGGACGG<br>ACGGTGTACCGCGACGAGGAACAGTACCGAGCTCTTAGGGAAGCCCATCAAGCCACCCATGCCTTTAGGTATGACGCAAGGGACGC<br>GGCTATATACGACATCCCTATGGCAGAAGGGGTGGCGCCTCTGGGTACTCCCGTGAGGATCAAAACTAAGGACCACCTCGCTCTGC<br>TCGGCAAAGCGGCTAACCACGCGCTGCTCGATTGGCTCGCACCACGCAGAACCATTCTGCGGAGGGCGAGACCTCTTCAGTGCTGG<br>GGCAACAGGAAGGCCTCACTGTTGTCAGCCGCCGTGCGGGATCAAGGACTTGCCGAAACAAAGGGTCTGGATGTTCTGGTAAGGCA<br>TTCTTTTGATTTGAGGGCTTTGGGCGCACCTCACCAGGGTGCTGAACCGTACCTTGCCCTGATGTTGGACGTGAGTACGAGCAATG<br>AGCTGGAGATACCTGTGGGCGAGCTTCTGCGCGAGAGATTCGACCCCATCGGTCGATACGTTTGTGCCAGAGCCGACTCTGGCCAA<br>GATAACGTACTTGCTAGGTTGGAAACACTGGGTAGGGTCGTGGGTGTGGATGGTGGTAAGCTTCAACTGAACGACTTTACCGGAGA<br>AGAATTCGTGGACGCTGATTCAGTCACGTTGGAGCCTAGATTGGAGAATCTCGATGCGCTCATTCGCCACTTCTATCCCAGGGATG<br>CGCCAAAAATCCTGGAGGGCCTTCGCAAAAGGAGAGTGCCTTTCTCCACCGCGAACGACAAGCTGGCGAAGATACGAGAAGTGCAC<br>GGAGGAGTAGCCGGCCACCTTGAAACGATTAGGATCGCTGGCATGGCTATAGAGGTGGGTGCCCTGCTGCAGAGAGGCTCTAACCT<br>GTTTCCCCCACTCATAAGCACGGACCGGCCTGGATTTCTGTTCGGCGACCTGTGATCGCCATCATCTGCGAGAGCAGGTTTCGGGGT<br>TGAAGCAGCATGGGCCCTACAAGTACATGCAACACGAGCGCAATGAACCTGTGATCGCCATCATCTGCGAGAGCAGGTTTCGGGGT<br>CGGATAGACCAACTCGCCCGAACACTTCGCGATGGTGTCGCGGAAGATGCCTGGCAAGACGCGATGAGGGGCAGAAATAAGGTGCC<br>GGAAAACCCCTTTAGAGGCGGGCTGATCGGTAAATTGAGATTGTCTCGGGTGCAGTTTGAGTTCGAAGAAGTAACCGAGCCCACTC<br>CCGAAGCCTATCGCGAGGCCATCCTTCGGCTGCTTGCGAGACTCCCAGAGACACCCGACCTCGCGTTGGTTCAAATACGAGCGGAT<br>TTTAAGCAGCTCCGCAACGACAGGAACCCATACTTCGCTGCAAAGGCCGCATTCATGACGGTGGGAGTGCCCGTGCAGTCCGTACA<br>AGCCGAGACTGCGGACATGCAGCCCAGTAATTTGGCCTACATGGCCAACAACCTGGCCCTCGCCTACGCAAAATTGGGCGGTA<br>GTCCGTTCGTGATCTCCACACGCATGCCGGCGACGCATGAGCTCGTGGTTGGCTTGGGCTACACAGAGGTGTCAGAAGGACGCTTT<br>GGACCGAAGTCCCGATTTGTAGGCATCACCACCGTGTTCAAGGCGATGGCAGGTACTTGGTGTGGGGGCAAACTAGAGAAGTAGA<br>ATTTGAAAACTACGCCGACGCTCTCTTGGCGAGTCTGAAGACTACCATCGACACAGTGCGCAAGGACAATAACTGGCAGCCACGCG<br>ATCGAGTGAGGTTGGTATTCCACGTGTATAAGCCCCTTAAACAGTTGCCGATGACGCTATCAAACAGTTGGTGCAGGAGTTGCTG<br>AAGGGCGAACATGAAGTGGAGTTCGCATTTCTGGACATCTCCCGCTTCCACGATTTTGCCCTTTTCGATCCTTCCCAAGAGGGCGT<br>GAATTACTACGCTGACCGCAGACGACTGCTGAAAGGCGTGGGCGTCCCCCTTAGGGGTATCTGCCTCCAACTGGACGAAAGGAGCG<br>TGCTCTTGCAGCTGACAGGCGCTAAGGAGGTGAAGACCAGTGAACAAGGTCTGCCCAGGCCCCTGCGACTGACGTTGCATTCCGAG<br>AGTGATTTTAGGGACCTCACATACTTGGCGCGACAGGTGTACAGCTTTAGCTACCTCTCCTGGCGCAGCTACTTCCCGGCCATAGA<br>GCCGGTGAGCATTACCTACAGCAGACTTATTGCCAATGCACTTGGCAACCTTAAGAGCATCCCGAACTGGAACAGCACATTCTTGA<br>CAGCTGGCCCACTGAGGTCAAGGATGTGGTTTCTGTAGTAA |

TABLE 17-continued

Argonaute nucleotide sequences containing 2X Nuclear localization sequence (NLS) from Simian Vacuolating Virus 40

| SEQ ID NO | Sequence |
|---|---|
| 115 | ATGCCTAAGAAAAAGAGGAAAGTGGAGGATCCGAAGAAGAAACGAAAGGTCGGCAGCGGCAGCATGTATCTTAACCTCTACGAAAT
CAAGATCCCCTACAGGGTTAAACGATTGTACTACTTCAATAAGGAGAACGACCCCAAAGAGTTCGCCCGGAATCTGAGCCGAGTGA
ACAACATACGGTTCAACGCACAGTAAGGACTTGGTGTGGCTCGAAATCCCCGACATCGACTTCAAGATTACACCCCAGCAGGCGGAA
AAGTACAAAATAGAAAAGAATGAGATAATTGGGGAGAAGGAAGACAGCGATCTGTTCGTCAAAACCATTTACAGGTACATCAAAAA
AAAGTTCATCGACAATAACTTCTACTATAAACGGGGAAATAACTACATTTCAATCAATGATAAGTTCCCGCTCGATTCTAATACAA
ACGTTAATGCGCACTTGACATATAAGATTAAACTGTACAAGATAAACGAACGGTATTACATTAGCGTGCTTCCAAAATTCACCTTC
CTCAGTGACAAGCCAGCCCTTGAGAGCCCCATCAAGAGCACCTACCTGTTCAACATTAAAAGCGGCAAGACGTTTCCCTATATTAG
CGGGCTCAACGGAGTCCTGAAAATTGACCTGGGCGAGAACGGCATAAAGGAGGTCCTTTTTCCGGAGAACTACTATTTCAACTTTA
CCTCCAAGGAGGCCGAGAAGTTTGGGTTTTCTAAGGAAATCCATAACATCTACAAGGAAAAAATCTTCAGCGGCTACAAGAAAATC
AAACAGAGCTTGTATTTCCTCGAAGACATCATCAATATAAACAATTACAACCTTACCATGGACAAAAAGATCTATGTGAACATAGA
ATACGAGTTCAAAAAGGGCATCAGCAGAAACATAAAAGACGTGTTCAAATACAGCTTTTACAAAAATGACCAGAAGATCAAAATTG
CGTTCTTTTTTAGCAGCAAGAAGCAAATCTATGAGATTCAACGCAGCTTGAAGATGCTGTTCCAGAACAAGAATAGCATATTCTAC
CAGACCATCTACGAGATGGGGTTCAGCAAGGTGATTTTTCTCCGCGAGCCGAAGACTAACAGCAGCGCATTTATGTATAACCCCGA
GACCTTCGAGATTAGCAACAAAGATTTCTTTGAAAACCTGGAGGACATTATGGCAATCATTATACTCGACAAGTTTCTGGGCA
ATATCGACAGTCTTATCCAAAAATTCCCTGAGAACCTCATCCTTCAACCCATACTCAAAGAGAAACTGGAAAAGATTCAGCCGTAT
ATCATTAAGTCCTACGTCTATAAAATGGGAAACTTTATTCCAGAGTGCCAACCATACGTCATAAGGAACCTGAAGGACAAGAACAA
AACCCTCTACATCGGCATCGACCTGTCCCACGACAACTATCTCAAGAAGTCTAACCTCGCCATCAGCGCCGTAAACAACTTCGGTG
ACATTATCTACCTGAACAAGTATAAGAACCTTGAGTTGAACGAGAAGATGAACCTCGATATAGTCGAGAAAGAGTACATACAGATC
CTCAACGAGTACTACGAGCGCAATAAGAATTACCCCGAAAACATCATTGTTTTGCGAGACGGACGCTATCTCGAGGACATAGAGAT
CATAAAGAACATACTGAACATTGAGAACATCAAGTACAGCCTCATCGAAGTTAACAAGTCCGTGA/TATCAACTCCTGCAAGACC
TTAAAGAGTGGATTATCAAGCTTAGCGACAACAATTTCATATACTATCCCAAAACGTACTTTAACCAGAAAGGTGTAGAGATAAAG
ATAATAGAGAACAATACCGACTACAATAATGAGAAAATACTGGAGCAGGTGTACTCACTGACGAGAGTGGTGCATCCCACCCCCTA
CGTAAACTACCGCTTGCCCTACCCCCTGCAAGTCGTCAACAAGGTCGCCCTTACCGAGTTGGAATGGAAGCTTTATATCCCTTACA
TGAAATAGTAA |
| 116 | ATGCCCAAGAAGAAGCGGAAGGTGGAAGATCCGAAGAAAAAGAGGAAGGTTGGCAGCGGGAGCATGACTGAGGACTTGTACCTCGA
CTACGACGCGTTCCTGCGGAGCTTTAAAAGAAACATAGATGTGCCGCACTCCTTTCTCCTGGGAGCAGGTACATCCATTAGCAGTG
GCATCCAGACCGCCTACGATTGTATCTGGGAGTGGAAAAAGGACATTTACCTCTCCAAGAACATCAACGCCGCTGAGTTCTATAAG
AACCATAAGGACGAGGCGGTAAGAAAGAGCATCCAAAAGTGGCTGGATAACCAAGGTGAATACCCAGTTCTCGACAGCACGGAGGA
GTATTGCTTTTATGCCGAAAAGGCCTATCCCATCCCCGAGGACCGCCGCAAGTATTTTCTGTCTCTTATCGAAAATAAGGAGCCCT
ACATAGGGTATAAGCTCCTCTGTCTGCTGGCCGAGCGCAGCATTGTAAAGGCTGTCTGGACTACTAATTTCGATGGCTTGACCGTC
AGGGCTGCTCATCAGAACAAGTTGACGCCCATTGAGATAACCCTCGATAACTCTGATAGAATATTTCGCAACCAGTCTACCAAGGA
ATTGCTCACAATTGCGCTGCATGGTGACTACAAATTCTCTACGCTGAAAAATACGGAGAAGGAGCTCGACAACCAGAACGACACAT
TCAAACAGCAGCTGGGGACGTATCACGTGGACAAGAATATGATCGTAATAGGCTACTCAGGGCGCGACAAGAGCCTCATGGACGCC
ATCAGCGAGGCCTTCAGTACGCGGGGTGCAGGGAGGCTTTATTGGTGCGGCTATGGCGAGACGATCCCCAACGAGGTTAGCGAGCT
CATACTGAAAATCAGGTCCCAGGGTCGCGATGCATACTACATATCAACGGATGGATTTGACAAAACGCTGATACACCTGTCTAAAA
GTGCGTTCGAAGACAACCCCGAGATTACGAAAACATCCAACTCGCGCTCGAAAACAGCGCGGACGAAGAGTACTTTAAGACTGAC
TTTTCACTGAACTTTAGCAAGCCGGATAAGTTCATCAAGTCAAACCTCCACCCCATCGTGTTCCCGAAAGAAATCTTTCAATTCGA
GCTTGACTTCAAGGAGGACAAGCCTTGGCAACTCCTCAAAACTATTTCACGCGAGACAAACATTTGCGCGTCCGTTCAAGGGTA
AGGTGTTCGCACTGGGCACGCTTACTGACATTGGGAACGTCTTCAAGAACGCCTGAAGAGTGTATATAAAGCGCGAAGCAATTAGC
ACCTCCGACGTGGATAATGTGAGTGCCTTTAAATCTCTGATGCTGCAGGCTGTGCTGAAGTTTTTCATTGGTATCGAAGGCGTGGA
GTCCAACCTCAAAGACAGATTGTGGCTTACCAACGCGGAGCAGCTCGTGGGTGATATTAGTGTGCATAAGGCTATCCACCTCAGCC
TGTACTTCGACAAAAACAAAGGATTCGCTTACCTGTCCTTCACCCCCACCGTACAACTCATCTCTCCTGAGGAAATCAGCAAAATC
CAGAAGCAGAGAATCTCTAAGAGTAAACTCGAGAAGCTGTTCAATGACAAGTATGACAGAGATATTGGAGTTCTGGAACCAAAAGCT
CTTTTAACAATAGCCAAATCAAGTTCGAGTACCCGATCAGCTCAGGTAGTGGGTTTGAGTTCAAAATCTCCGCCAACACCGCATTTG
GGGAGATAAACGTATTGGACCCCAACTTTCGCTCCTTTTCCCCTAGAAATTATGACCCGAAGCGCACACAGTTTAAGGGCGTGCAG
TTCCTCGAACCGCGCTGATATTCCGCAACATCAGTACTAATGTGGAATTTAAGGACTACCACCCCGATGAGGGGCTGGTGAACAA
CCGACCGTTCGACGTGAACCTGAACGGTATAATTCATTCTAACGAAATAAACCTCACGGTCATCTGCGGCAAGTCATACGCCAACG
ACCTGTATGAATTCCTGAGCAAGCTCCAAGTGAAGCACGCCACTGAGAATGTCAACCCGGACTATCTTATTGAGTATCCGGGCTTC
CAAAGTGTGTTCAACCTGCCACTCAACATACCCCACTTTGACTCTTCCGAGAAGTGGTACGACATCGACTTCGTAGCTGACAATAA
CGGGGAGAACCACGAGAATGCCATTAAGCTTGCCAGACTCATCACCACAAGATCGACCAGATTGCCTCTACACAGAACCAGAGCA
CGGTCGTGGTGTTTATTCCAAATGAATGGCAGTTGTTTGAGGGGTACCTGAATCAGGGGGAGAGTTTCGATTTGCACGATTACATC
AAGGCATTCAGCGCTAGTAGGGCATTTCAACGCAGCTCATCCGCGAGGATACACTGGCGGATACGTTGAAGTGCCAGATCTACTG
GTGGCTGAGCCTCTCATTTTACGTTAAAAGCCTGCGAACTCCTTGGATTCTGAATAATCAAGAAAAGAACACGGCCTACGCCGGGA
TCGGTTATAGCGTGACTAAAATACAGGACCGGACGGAAACGGTGATCGGCTGTTCCCATATTTACGATTCCAACGGCCAGGGGCTC
AAGTATCGGTTGAGTAAAATTGACGACTACTTCCTTGACAATCGCAATAATCCATTTCTTAGCTATAAGGATGCGTTCCAATTCGG
TGTGTCCATACGGGAATTGTTTTACCAGTCCCTGACAAATTGCCTGAGCGGGTAGTTATACACAAGCGGACCCGATTTACCGATG
ATGAGATCAATGTATTAAGGCGTCTCTGAACAAGCGGGGATTAAGAAGATTGACCTGGTGGAGATTAACTACGAGACGGACGCC
CGCTTCGTGGCCATGTCCGTATACCAGAATGCACTGCAGGTAGACCGATTCCCTATCAGTCGGGGTACTTGTATAGTCACAAATAA
GTACACTGCCCTTTTGTGGACGCACGGGATTGTCCCAAGTGATACAGGCAGCCAAACTACAAGTTCTACCTTGGCGGTAGAAGCATAC
CGGCTCCGATCAAGATCACAAAGCATTATGGTGATATAATAGACGTTATCGCCACCGAAATCCTTGGGCTGACAAAATGAAC
TGGAACTCCCTTGACCTTTATAGCAAACTTCCCTCTACGATCGACTCCAGCAATCAGATCGCTCGGATTGGCAAACTGCTCTCCCG
GTACGAAGGCAAGACGTACGACTATCGATTGTTTATCTAGTAA |
| 117 | ATGCCGAAGAAGAAAAGGAAAGTGGAGGACCCCAAGAAAAAGCGCAAGGTTGGCAGCGGGTCCCTGGAGAACCTCACCATAAACAT
AATCCCCCTTCAAGCACCCCAGCATCCAAAAAGAATTTGGCTTCTATACCGAGAAGAAGGAGGGCTATTTCCCCATTCATAGGACCG
AGTTGCCCAACGAGCTGTGGGACAACCAGAAAGAGGAAGTGGTGAAGCACAAGTTCTACTACACGAACTTTGAAGACACGGAGGAT
TGCGTTCTGAAGACCAAGGTGGACCTGTATAGTAGCACTAAGTTTGCCAGCATCTGTACACGCAATTGGTGTACCAGTATTTCAT
TGGGATAGCGGATGCAATCCAGTTCAACTACGTGGGTGACATAGAGGTTTGGCTGCTGGATGCGAAAGCCAGCACCACCAAATACA
ATAGCTACAACAAGTATACCCTGAAAATAGAGTTTAGCGGTCTGACCAAGAGCCCCGCTCTCCTCCTCAGCTATGACAACACTAGT
AAGGTAGCGACTACGAGCATAGACGAAATCAACATTCCCACCGAGTACTTCAAGACCGTCGTGTATAACAAAGAAATCCAGAGGTT
CAAGTACCTGACCGAGGACGCGAAACAACACCTCGATCAAGTGTATCCCCTGCTCAACATACCGTTGAAAAACCATCTTGAGATTC
CTCACACCGTTCCCCGCAAGGGCAACAGGTATAAGCCCTACTTTAACCACATTACGACTTTTTACACAATAACTATTTGAACACCGAC |

TABLE 17-continued

Argonaute nucleotide sequences containing 2X Nuclear localization sequence (NLS) from Simian Vacuolating Virus 40

| SEQ ID NO | Sequence |
|---|---|
|  | GAATTCAGGGCCATCCTGCCCCTTGATGAGAATGGATTCTTCAATATCCCAGAGGACAGCATTTTGAAAACTAGCAAAAATTCTAA
CAACCTCCGGTTCTATAAGAAAGTCGGAGTAGATCCCAAGGCTGGAATGAAGAAGCCCGGTCCCTACAAGGCCTCCCCCCACGACA
ACGTGAACCTGTTCTTTATCTATCACAAACCCGACGCACATGAATACGCCAAAACGTTGCATGACTACTTCATGGAGGGGTACAAA
AAGTTCTTTCCCCCCCTCAAGAACGTTATCCGGCAGCCGCTGTTCCTGGACAAAGGCACCTCACTTGCATTTGAGAGCTTCGACAG
CTGCATCGCCGAGCTGAAAACCCATCTGTTCGACCTCAAAAAAAAGCCCAATACCCGGTACGTGGCCATCTACGTGAGCCCCATCC
ATAAGGAGGACGAAGACAATAAACACCTGTACTACCAGGTCAAAGAAGAGCTGCTTAAACATGACATCACCAGCCAGGTGATTTAC
AAAGAGTCCATCAAAGATAAATACTTCGGCGCTTTCCTCGAGAATATCGCACCAGCTTTGCTTGCAAAGATCGACGGCATTCCCTG
GCGACTGGACAGGGAGTTGAAACAGGAACTGATCGTAGGCGTCGGCGCCTATAAAAGCAGCGTCACCAACACAAGGTTCGTTGGAA
GCGCCTTTTGCTTTAACAACAAAGGAGAGTTCAAGAGCTTTGACTGCTTCAGGGAGAAGGAATTCGATCTGATTGCCGGGAAAATC
GGCAAGCAGGTGCTCACCTTCATTGAGGAGAACGAGAACAAGTTGGAGAGGCTGATCATCCATTATTTCAAGCCTTTCAACAAGGA
TGAGATAGATCTCGTGCAGGAGACCCTCGGCCTGCTGAAGCTGGAAATCCCCATCATCATCGTGACTATCAATAAGACCGAGAGCT
CCGATTACGTCGCTTTTGACACCAACGACGACGCCCTGATGCCCCTGAGCGGCACCATTATCGAGATAGCACATCTGAAGTATCTG
CTGTTCAATAACGCGAAGTACAGCAGCATCGGCTTCGCCAAAGACCACCCCTTCCCCGTTAAGCTCAGTCTGTACTGCACCGACCA
GGATTACTTCGAGGACATCGCCATCGTCAAGGAGCTCATAGATCAGGTTTATCAGTTTTCTAGGATGTACTGGAAGAGCGTCAAGC
AGCAAAACCTGCCCGTGACAATCAAATACCCCGAGATGGTGGCCCAAATCTTCCCACACTTTGAGGGCGATAAACTGCCTGATTTT
GGAAAAAACAATCTCTGGTTTCTGTAGTAA |
| 118 | ATGCCGAAAAAGAAGAGGAAGGTTGAAGATCCCAAGAAGAAACGAAAGGTGGGGAGCGGCAGCGTGAGGCTGGTAAACCAGAAAGA
GAAACGGAAGGCGACTACGTGTATGGCTACACTCTCCCAATAGACCCCAGTAACAGGAACATGAGGCAGCCCTTCTGGATAAGCA
TGGATAAAAAGGAGGGCTATGAAGCTCATTTCGTTGGCCCCTATGAGAACATTGAGTTGACCAAGAGCGTGATCTTCTGGGACCTT
CTGAGGAGGACCAGGGAGCAACTCAGCAGCGATAAGTTCACGGAATCAAGAAAAAAGTTCTTTAAGGAGATCTACTTCCCCCTTAA
CCTCTACAATGAGGGCAGCCAAGGGCTCGCCGTGCAACCCTACTACCTGAAGATTGATCAGCAATTTGGACTGCTGGTGGATTTTC
AATTCAAACTTGACAAGATTTCACCTTCAGCCGGAAGATTCAACAGCTCAGTCTGACATTGGATGGGAAGAACCGGAGGAACCTC
AACTACTACGTCGACAGGATAACCAAAACCAACCAATTCATCAAGGCCCTCTGGAACATCATTGGCACCTTCTCCCATAATGAAAA
CAAGGAAAACTACACGCTGAGGAACGACTTCTACCCCTGCGCCGCAAGCAGGCTGCGGTCTCGAATGTATCTCTTTTCCAATGGCA
GTGAATCCAGGAGCCAGTTCAATGGCTTGAAGGAATACGGCCCACTCCGACCCCTGACAGCCAATCCGACACTGCTGTTTGTGTTC
CGGGAACAAGACCGCGACGCCGCGAGAAAACTGGCGATGGCACTTAAAGGCAGCAAAAAGCAAGATCAATACAGCTTCCCCGGGTT
CAACTCCCTGTTTAAAGCGGACCTGTTGATCGACGGAAATCCCATGGTCTTGAAAGACTTTTCTATCGAGAGCAGCAGGGAGGTGT
TGGCCAGGGTGACAACATCAACATCCAGCTTGTTGCCCATTTTCATCCTGCCCAACCGCGAGGGCGACGGCTACCTGGAGCACAAA
GCCATCTTCGCCGAGAACGGCATACCTACTCAAGCGTGCACACTCCAAGTCATTCAGGACGACGTGACCCTTAGGTGGAGCGTCCC
CAACATCGCCCTGCAAATATTCTGCAAAGCGGGTGGCTGGCCCTGGAAAGTGCAGAGCCCCGTAACCGACAACGCCCTGATTATAG
GCATAAGTCAGAGCCACAAGTTGAATTATAGTGACGGTAAGACAACTGTGGACAAGCACTTCGCTTTTAGCGTGCTGACTGATTCA
AGCGGCCTCTTTCAGAAAATTCAGGTGCTGAGCGAGCAGAAGACGGAGGAGACCTACTTCGAACAACTGAAGCTGAATCTCAAAAG
CATCCTGAACGCCAATAGCAAGAACTACCAACGCATCGTGATCCACACCTCATTTAAGCTCAAATACAAAGAAATAAGTGCAATCG
AGGAAGTTGTTAGCGAATTTGCAAGGAACAGCAACAGCGCCGACTGCAAGTTCGCCGTTGTGAAGGTTAATCACAAGCATAGGTAC
TTCGGGTTTAATCGGGAGTGAATAGCTTGGTGCCCTACGAGGGAACCGTGTGTAAGCTGGGCGATAGAGATACCTGGTCTGGTT
CGAGGGTATCTATCAGGAGAAGCCGACCGTTACCAAAGCATTTCCGGGTCCCACCCACATCGAATTTCTTAAAATCGGGTCTAATA
ACGTGATTAGCGACGACCTTTTGTTGCAAGACCTGATGAACTTGAGCGGAGCGAACTGGAGAGGCTTTAATGCGAAGAGTGCTCCG
GTATCCATCTTTTACTGCCACCTGGTGGCCGACATCGTGCATGATTTCCAAATCAAAGGCCTCCCTATGCCCGCCATAGATCTTAT
ACGACCCTGGTTCATCTAGTAA |
| 119 | ATGCCAAAGAAAAAACGAAAAGTAGAAGACCCTAAAAAGAAGCGGAAAGTAGGGTCAGGCTCTATGCTTCAACTGAACGGCTTTAG
CATCGAAATCGCCGGAGGTTCCCTGACTGTCTTGAAATCTAAATCGCGCCTACCGACGTTAAAGAAACCCGCAGGAGCCTGGAAG
ACGACTGGTTCAACCATGTATCACGAGGGCCACTTGTACTCACTTGCAAAAAACAGCAACGCATCGGTGATTGGGTGAGACCGAG
CTCCTGGTCCTGTCTGATCATCTGGGTCTTAGGTTCGTTAAGGCTATGTTGGACCAAGCCATGAGGGGCGTATTCGAGGCCTACGA
CCCCGTTAGAGATAGGCCCTTCACATTTCTGGCGCGAAACGTAGATCTCGTAGCCCTCGCGGCAGAAAACCTCGAGTCCAAGCCCA
GCCTTCTCTCCAAATTCGAGATCAGGCCCAAGTACGAACTGGAGGCCAAGGTAGTGGAATTCAGACCGGGCGAGCTGGAACTTATG
CTGGCGCTCAATCTGACTACACGGTGGATCTGCAACGCCTCCGTAGACGAGCTCATTGAGAAGAACATACCGGTCCAGGAATGCA
CCTGATCCGACGGAACCGGGAGCCGGGACAGAGAAGCTTGGTTGGCACCTTCGACCGCATGGAAGGCGACAACGCCCTGCTCAGG
ATGCTTACGACGGACAAGACAAGATAGCAGCCTCACAGGTGAGGATCGAGGGGAGCAAGGAAGTCTTCGCGACCTCTCTGAGGAGG
CTCTTGGGCAATCGCTATACCAGTTTCATGCACTCCGTGGATAACGAGTACGGCAAGTTGTGCGGGGGTTTGGGGTTCGACGGCGA
ACTTAGGAAGATGCAGGGATTTCTCGCGAAAAAGAGTCCTATACAACTGACGGAGGGTTGAAGTGTCCGTGGGCAGAGGGTAC
AACTTACCAATCAGCCTGGGTATAAGACAACAGTTGAGCTTTTGCAGTCAAAGTACTGCTTTGACAGAATAGGACGAAGCTCCAC
CCCTACGCCTGGGACGGGCTTGCTCGATTCGGCCCATTCGACAGGGGCAGCTTCCCGACGCGATCCCCCAGGATTCTGCTCGTGAC
ACCCGACTCCGCGAGCGGTAAGGTCTCTCAAGCTCTGAAGAAATTCCGCGACGGGTTCGGCAGCAGCCAGAGCAGCATGTATGACG
GCTTCCTCGACACCTTTCACCTCAGTAATGCTCCTTTCTTCCCCCTTCCCGTGAAGCTGGACGGCGTGCAGCGCAGCGACGTGGGC
AAAGCTTATCGAAAGGCGATCGAAGATAAACTCGCAGACACGACGCTTCGACGCCGCTTCTTTAACATTCTCCTGGACGAGCACGC
CAATCTGCCGGACAGCCATAACCCCTATCTGGTCGCCAAGTCCATCCTCCTCTCCCACGGCATCCCAGTCAAGAAGCACGAGTGA
GCACTCTGACGGCCAACGAATACAGCCTGCAACACACCTTCAGGAATGTCGCCACAGCCCTGTACGCCAAATGGGTGGTGTCCCA
TGGACCGTTGACCACGGGGAGACCGTGGACGATGAGCTGGTAGTAGGAATCGGAAACGCGGAGCTTAGCGGGAGCAGGTTCGAGAA
AAGACAGAGGCCACATCGGAATCACGACAGTGTTTAGGGGGACGCAACTACCTGCTTAGCAACCTCAGCAAGAGTGCCGATACG
AGGATTACCCGGACGTACTCCGGGAGAGTACCATCGCCGTGTTGAGGGAGGTTAAGCAAAGGAACAATTGGTTGCCGGGTCAAACC
GTGCGAATCGTTTTCCACGCCTTCAAGCCTCTGAAAAACGTGGAGATTGCCGACATCATCGCGAGCTCTGTAAAGGAGGTAGGCTC
CGAACAGACCCATAGAATTTGCATTCTTGAATGTTTCCCTCGACCACTCCTTCACCCTTCTGGACATGGCTCAAAGGGGAATAACGA
AGAAGATCAGACCAAGGGGATATACGTTCCCAGGAGGGGCATGACAGTCCAGGTTGGGCCTACACCAGGCTTGTAACCAGCATC
GGTCCGCACATGGTAAAAGGGCAAACCTTGCCCTCCCGCGACCCCTGTTGATTCACCTGCACAAGCAGAGCACCTATCGGGACCT
GAGCTATCTGAGCGAACAGGTTCTGAACTTTACCACCCTGTCCTGGAGGAGCACCCTCCCCAGCGAGAAGCCTGTTACCATTCTCT
ACTCATCACTGATAGCCGACTTGTTGGGAAGGCTCAAGTCAGTGGATGATTGGAGCCCCGCAGTGTTGAATACCAAACTGAGGAAT
AGCAAATGGTTCCTGTAGTAA |
| 120 | ATGCCGAAGAAAAAGAGGAAGGTTGAAGACCCCAAAAAGAAACGCAAAGTGGGCAGCGGAAGCATGTCCGGCCTTTTCCTGAACTT
TTACCAGGTAGACATCCCCACCCAAATCCGTACCGATCCACAGCGTAGAGTATAGCCATTACAGTTCAAAGGAGGCCTTTATCGCGT
TGAAAGAAACTTCCCCTACTTTAGCTTCTACCGGGATGACGACCGAATACTGATCTGGAAGAAAGACAAGGATGCCGAGCTCCCC
GAGAAGAACTCATTGATTGAAATTGATTTCACCGAGAAAGCGAAGGTCCTCAGCAAAATACTCGAGAGGGCCATCATTGACTTCAT |

TABLE 17-continued

Argonaute nucleotide sequences containing 2X Nuclear localization sequence (NLS) from Simian Vacuolating Virus 40

| SEQ ID NO | Sequence |
|---|---|
|  | CGAGCCAAAGGGCTACAAGATATTCAAGAACAAGTACAGCAACAGCTGGGAAATAGTGAGCATGAAGGACATCCTGAATGGTGGGA<br>TCGAGGGACTCAGCATCAATCGAATCGTGCATTTTTCCCCCTGCTTCTTCTTCAAGGAGAACAAACTCATGCTGGGTTTCAGCCTT<br>AGCACAAGCCTCAAAAACGTGTTTACCTGGAATAAGGCGGACTTCGAAAGGTACGGCTTTGACATCAAGGGCCTTAAAGGAGACGA<br>AGAGCGGATTTTTGCCAACAAGCAATCCCTTAAGAGGTTCCTGGAGACCAAGGGCGCAGTTGCAATGTATGACCAAATTATCGCAA<br>AGGAAAACAAGAACGCGAAAATGTTTAGCATCATCGACGGCTTCTATCGGTGGCTGGAGAGGAACAAGACTGAAATCCAGCTTCCA<br>TTCGGACTGAAGATAAATTCAGTGTCTAAAAAGTACCTGCCGTTCGAGGATGAGCTGATCAAGAGCGAGATCATCCCTAAGCCCCA<br>AAGGTATTTCTATAGCAATAGGAAGAACACCCAGAGCCTGCGGTACTATGACGAGATGGTGAAGACTTATCAGCCCTACTCTCTGG<br>AGCTCTACCAAAACAAACAGATCAACATCGGAATCATCTGCCCCAGCGAGTACCAGGGAGAGACGGAGGGGTTCATAAAGAAGATC<br>GAACTGAAGCTCAAGGAAGTATTCCATTTCAACAGCCTGATCTTTCACTTCAAGACCATTACGAACAAGGACCTCGCGTCCTATAA<br>GGAGGTTTTGTACGACGATGAACTGCTGAAGTGCGACCTGATTTACGTCATCGTGAATGAGGCCCAGGAGAAACTCTCACCTAATA<br>ACTCCCCTTACTACGTGTGCAAGGCCAAGTTTATAGGCAATGGCATACCTACGCAAGACATTCAGATTGAGACCATCCGGCAGAAC<br>TTGAATGCGTTCACAATGACGAACATCTCACTTAACAGCTACGCCAAACTGGGAGGCACCGCGTGGACCATCGAGAAGGAAGACAA<br>ACTTAAGGACGAGCTGGTCATTGGCATCGGCTCCACCCTGTCAGAAAACGGCCAGTTCGTGCTCGGATCGCACAAATCTTCCATA<br>ATGACGGGCGCTACATGGCGGGTGACTGCAGCCCCCTTTCTACCTTCTCCAACTACGCGGAGAACCTGGAGGATCACCTGTACAAG<br>ACCCTGAAGCCCCTGGTGGAGGAGATGAGCAAAAGCGGCACCTTCCGCTGATTTTCCACTTGTTTAAAAGTGCCTCTGAGGAGTA<br>CGAGATACGCGCGATCAACGGCCTGCAGAAGAGGCTGGCGAACTACAATTTCGAATTTGCACTCGTTCACCTGGCCTATGGACACA<br>ACTTCCGACTCTACTACAACGACGGCAACGGCGACATTAATCAGGGCACATATATACAACTGTCAAAACACAGCGCCCTGCTCCAC<br>TTCGTTAGCAAGTCAGACTTGCCCCTGAAAATCGACCTGGACAAGCGGTCTACTTTCACCAGCCTGTTTTACATCGCCAAGCAGGT<br>GTACTGGTTCAGCCATCTGAGTCATCGCAGCTATATGCCCAGTAAGAGGACCGTGACCATCATGTATCCGTCAATCATGGCGAAGA<br>TGACCGAGGAGCTTAAGAAGGTGGAAGGATGGGACTACGAGCGCCTGAAAGCAGTAAGCGATAAGCTGTGGTTCATCTAGTAA |
| 121 | ATGCCGAAGAAAAAAGGAAGGTGGAGGACCCAAAGAAGAAACGGAAAGTTGGCAGCGGCTCCATGAGCGTGGCGATCGTGAGCCC<br>CCAAATGTACAAGAGTCTGAGCGAGGTGTTTCCTCTGACCGCCTCCCAACTGAACTTTATGTGCTTTAGGCTGACTCCCGAAATCG<br>AAAAGAAGGATGGTAATAGGCTCAGCTACCATTTCAGTCTGAAGCTGCCGGAACATGTTGTGATCTGGCACCAGCCCTACTTCTGG<br>GTGTTGGCGAGTAGTAACAGGCAAATCCCCAATAAGGACGAGTTGCAAGAAACTCTGATAAGGATCCAAAACGAGGTGGATGACTT<br>CAAAGAACGACTCTTCGGTTTCCAGAGCGTTCGCCACCCCCAACTCACCCCCTTTATCATCAGCCTCTTCGCCGTGCAGGTCCTCA<br>AAAAAACAAAGTTCGACTACCCCATTGCATTCAGCAACAACGGTGTAATCGTCAGGAGGGAGCCCGACTTTTGGACGGAGAGCATA<br>GAGCTTCAAGACAGCCTGCATCCTGCCCTCACGCTGACCGTAAGTTCATCAATAGTGTTCCGCGACAACCTCGCGGAGTTCTATGA<br>AAAACATCATCAAAGGGAGAAGCCCGAGCAGTTTCTGATCGGCCTGAAGGTGCAGGAAATAGAGAGGGGCAACAATGCGATCATCG<br>TGGGACTCGTCGGCACCATCGGCGAGCACCGGGACCAGCTGCTTGAAAAAGCAACCGGGAGCACTAGCAAGCAGGCGCTGCGAGAG<br>GCACCGGACAACCAGCCGGTGGTTGCGATACAGTTCGGCAAGGATACGAAGCAGTTCTACTACGCAATGGCCGCGTTGCGGCCGTG<br>CGTAACCTCAGAGACGGCAAACCAGTTCGAGGTAGAGTACGGTAAGCTCCTGAAAGCTACAAAGATAAGCCACCAGGAGCGAACCA<br>ACCTGCTGGCCTCATACAAGAAGACGGCCCAGGAGTCATTGGCCGCTTATGGCATCCGCTGGAGCTGAGTGTGAATAGCAGGGAT<br>TACCCCAGCTTCTTCTGGCAACCCCCCGTGAAGATCGAAGATACCAAACTTCTGTTTGGCAACGGCATAACCGGCAAGCGGACTGA<br>GGTGCTCAAGGGGCTTTCTATAGGGGGCGTGTACCGACGCCACGGGAAATTCCAGGACAAGTCAAAAGTGATCCAGATCGCGGCTC<br>TTAAGCTTTGCGACGTGACCGTTAGCTTGTTCCTGAAGCAACTTACTCAAAGGCTGGCAAAATACGGCTTCCGAAGCGAGATAATC<br>ACCAAGAAGCCTCTGTCAATCAAGAACCTTGCCACCGCCGAAGCCAGGGCTGCTGTTGAGAAAGCGGTCAATGAGCTCGTGAAAT<br>ACCCCACGACATCGTGCTTGCCTTCCTGCCTGAGTCCGACAGGCACACCGACGACACGGATGAGGGTTCCTTCTATCACCAGATCT<br>ACTCCCTTCTCCTCAGAAGACAAATAGCCTCACAAATTATCTACGAGGACACCCTGTCCAACTCTGGGAACTACCAGTACATCCTG<br>AACCAGGTCATTCGGGGATCTTGGCGAAACTCGGGAATCTGCCCTTCATTTTGGCGGAAAGCCTCGATATAGCGGACCACTTCAT<br>CGGACTTGACATCAGCAGAATCTCTAAGAAAACGCAGGTCGGGACACGAAACGCGTGCGCCAGCGTGCGACTTTACGACGCCAGG<br>GTGAATTTATCCGCTACCGGCTTGAAGACGACCTGATCGACGGCGAGGCGATTCCACCCAAGCTGCTGGAAAGGTTGCTGCCTGCG<br>ACCGAGCTTGCGAATAAAACCATACTGATCTACAGGGACGGGAGCTTCGTGGGCAAAGAGGCCGACTATCTTGTGGAGCGAGCCAA<br>GGCGATAGACGCGAAGTTTATCCTCGTCGAGTGTAAGAAATCCGGCGTGCCGCGCTTGATTAACTTGGAGCAAAAGACCGTGATCG<br>CGCCGAGTCAGGGACTGGCTCTTCGACTGAGCAGTAGGGAAGCAATACTCGTGACCACCAAGGTGCCCGATAAAGTGGGCCTGGCT<br>AGACCCATCCGGCTCACAATCCACGAAAAGGGCCATCAAGTAAGCATCGAATCCGTGCTGGACACTACACTCAAGCTTACTCTTCT<br>TCACCATGGCGCGCTGAAAGAACCGCGACTGCCCATGCCCCTGTATGGGAGCGACAGGATGGCATACCTCCGGCTGCAGGGGATAC<br>GGCCTAGCGTTATGGAGGGCGACCGCCAATTCGGCTGTAGTAA |
| 122 | ATGCCCAAGAAAAAGAGAAAGGTGGAGGACCCAAAGAAGAAACGGAAAGTTGGCTCTGGGTCAATGAACCTGACCGTAAACCTCGC<br>CCCCATCAGCGTGCAGGGCGACTGCTCAGTCCTGATTGGCAGACAGCGCTACGACGAGCAGAGGCTGGCTGAACTTAGGTCAGACT<br>TTCGGGGCACCCACGTGTTTCGGCGAGACGGTCCAGATAGCATGATTGACATCCCCGTGGTCCCCGACGCGGCACCTCTGGGCAAC<br>CTGAGGGAGACGATCGACCTTAGGCGGTACCAGCGGCTGTGGCCCATGCTTCTGCAGGAGTCCCTCCATCCAGCTGCTTGGTAAGCG<br>CCCCATCCAGTCCAGCAAGCCCTTGAAGTTCCTGGGAGCTAGGTCTCCTCTGATCGAGCACCCGGATCTCCCTGAGTGGTTGAGGC<br>GGGTGAGCGTTACCGAGATCCACACCCGACACATCACCGTGGACGGCAAGCAAATCTACGGTATCGTGTGCGATGTGAGGGCCAAG<br>TCTTTTATCCTCGCCACCTGCAGCGAACTTCTGAAATTCGGCGTGACCATCCTTGGTAGATACGTCCAAATAGAACAGCCCGCGAT<br>AGACGAGGAACCATGCCTAAAAGGAAGCTCATCGGCAGGGTAAGGTCCATCCAAGGGGATGATCTGCTTCTTGACGACTGTGAGG<br>CCGGCTTCGAAAAAGTCGCTGCGAATGAGGCATTTCTCGAGCCGCGGAAGGAAAATTTCGAGGACTGCGTGAGGCAGGTGCTGAAG<br>CGGGACGCCGAGAGGGTGTTGAGAGGTCAGCTCGCGCCAGCCAAAACCTGGCCGCAGGCCCTGGGAAACTGGAACACATCGACGG<br>AATCATCAGGTATCTTAGGGAGAAGAAGCCCGCAGCGGTGCCCGGCTGCCATTTCGTGATCGATGCCATGCTCAACACAAACGGCC<br>ACATTTTTCCACCCGGGAACAATGGACAAACCCTTCCTCTTGTTCACGCGTTCACGGAGAGAAGACTGGCCCGAGAG<br>GGCCTTAAAGATCACGGCCCCTATGATGAGCAGGTGTTTTCCCCAAGTCCCTGAAGATCGCTGTTGTGTGCCAAAGCCGGTTGGA<br>GGGCAGAGTGGACGAGTTTCTGGCGAAGTTTCTCAATGGGATGCCGAAGGTCTTTCAACCCGGCAAGAGCTTCGCCCGCTACGCG<br>ACGGATTCGTGAAACGATTCAGACTGAACAAGCCCGAGGTGCACTTCTTTCTTGCAGATGGCAACTCCGACGAGGCATACGCCGTG<br>GCCAGCCGCGAGGCACTCGATAAAGCGAGGGATAGCGGGTTCGAGTGGAGCTGGCGATTGCGCAAATTGAGGAGGAGTTCAAGTC<br>ACTGGCCGACGGCTCCAATCCCTACTACACCACTAAGAGCATCTTCTGCGAGGGACGTTCCGGTGCAGAGCGTCAGGCTGGAGA<br>CCATGAGCCTGTCAGATAATGACCTGGTGTTCCCCATGAACCACCTGAGCCTCGCTACCTACGCCAAGCTGGGGGCGCACGCCCTGG<br>CTCCTGGCTAGCTCACAAAACCGTGGCGCACGAACTGGTGATCGGACTGGGTAGCAGCACCAGCTCCGAATCAAGGCTGGGCAGCCA<br>GATGAGACATGTGGGAATCACCACCGTGTTCAGCAGTGACGGCAGCTACCTGCTTTCTGATAGAACCGCCGAGGTGCCCTTCGAGC<br>AGTACCCACAAGAGTTGAGGAAAACGTTGCGAAAAACAATCGAGGCCGTCAGGGCCGAGGACAATTGGCGGAGTAGCGACAAGGTG<br>AGGTTGGTATTCCATTCATTCAAGCCGTTCAAGGACAGCGAGGTAGAAGCCATAGAGGCGCTGACCACCGACCTGGGCCTGGGCGA<br>CGTGAAGGCCGCCTTTCTGCACATTGCGCCCGACCACCCGTTCCTTATCTTCGACCACGACCAAATGGGCATCGCCGCACGAGGGG<br>GCAAAAAGGCGTGTTGGGCCCTGCTAGGCAGTTGCACATCCGGCTTAGCGACGCTGAGAGCCTTGTGGTCTTCGCAGGGGCCAGC<br>GAGCTTAAACAGGTGACGGATGGTATGCCGCGACCCGCGCTGCTCAAGCTGCACCCCAAAAGCACCTTCAAAGATATGACCTACCT |

TABLE 17-continued

Argonaute nucleotide sequences containing 2X Nuclear localization sequence (NLS) from Simian Vacuolating Virus 40

| SEQ ID NO | Sequence |
|---|---|
|  | GGCAAGGCAGGCCTTTGCCTTTAGTGCCCATAGCTGGCGGATGCTGTCCCCCGAACCTTTCCCAATTACTATCCGCTACAGCGACC TGATCGCCGACCGCCTGGCGGGACTCGCGTCTGTTAAGGGCTGGGACCCCGATGCCGTGACGTTCGGCGCTATCGGTCACAAGCCT TGGTTCTTGTAGTAA |
| 123 | ATGCCCAAAAAGAAGCGAAAAGTAGAGGATCCAAAGAAAAAGCGGAAGGTCGGGAGCGGCTCCATGGCGTTTAGGCCCGGTGAACG AGTCAGACCGCAGCTCGCGCTGAATGCGATCAGGGTCCTTACACCCCTGGCACCATCCCCGCCAGTGTAGTCCAATTCGACAGAG CGCTGCTGCACGCATATCTTGACAGACCCGAGAACGACGTATTCGCTACCCGACACGGGGAGACTGATATGGCGGTCGTACCCCTG ACCAGCGGTGCGAACCTGCCAACGGACAGAATGGGGCTTCCAGCTGCAGAGCACCTCAGGCTGGTATCTGCGCTGACAAGAGAAGC TGTGTTTCGCCTCCTCGCGGCCAGCCCGGAAGCGGATCTGCTGATCCGGCGACGCCCACCGACCGTCGCGGGGAAGAGAGAAAACG TACTTGCAGAGGACATTGGGCTCCCGGACTGGTTGAAGAAAAGACTTGTGCTGGAGTTCGACACGCGCATATTGCAACCACCGAGA GGGGACGCCTACGTGGTGCTGACGTGTAGTAAAAGGCTGCGCACGACAATAGACGCGAGTTGTCGCACCCTTCTGGAACTCGGTGT ACCACTGACGGGTGCCGCAGTCAGCTCCTGGAGGGAAGATCCTGACCCCAAGGTGAGCCGGCGATTGGCCTACGCTGGGCGCGTTG TAGAAGTAGGGCAGGACACGCTCACTCTGGACGACCACGGAGCTGGTCCGAGTGTTGTCTCCAGCGAAGACGTGTTCCTCGAGCCG ACTCGAGCAAACTTCAACAAGGTGGTGGAAGTGATAACCCAGGGTAACTCCGAACGAGCCTTCAAGGCCGTACAAAAAGCAGAAGC CGAATGCCACGCGGGAGGCGGACAATCGAAATAGTGCATGGTGTCCTCAACCAACTCGGCAACCGGTCAATGGTTCTTGCCGATG GCGTGCCTCTGCCGCTCGGGGGCTTGATAGACCAAGCGGTCGATAGCGACGCATTCCCCCCAGCCGAGGCGGTGTGGCGCCCTAAG CTCTCATTCGACCCCGTGCACAGCCCCGAGACATCAAATTCCTGGAAACAGCAGTCACTGGACAGGACGGGCCCTTTCGATAGGCA AACCTTTGAAACAAAGAGACCGCGAATCGCGGTTGTCCATCAGGCCGGAAGAAGGGAGGAAGTGGCTGCGGCGATGCGCGATTTCC TCCACGGAAGGCCTGACATCGCCAGCGATACGGGCCTGGTTCCCCACGGTTCAGGACTCCTCGGACGCTTTAGGCTCCACGAACCC GAAGTGAGATACTTTGAGGCCGCAGGCAGGGGGGGACCCGCTTATGCCGACGCAGCACGGAGTGCGCTCAGGGACGCGGCGTCAAG GGACGAACCATGGGACCTCGCAATGGTGCAGGTAGAGCGGGCGTGGCAAGATCGCCCACATGCCGATAGCCCGTACTGGATGAGCA AGGCAACGTTTCTCAAGAGGGATGTGCCGGTGCAAGCCCTTAGCACAGAAATGTTGGGTCTTGATGCATTTGGGTACGCGAACGCA CTTGCGAACATGTCACTTGCAACGTATGCGAAACTGGGCGGTGCCCCGTGGCTTTTGTTTGCCAGGTCACCAACCGACCATGAACT GGTGGTCGGGCTCGGAAGCCACACTGTAAAAGAGGGCCGAAGGGGTGCGGGTGAGAGTTTGTCGGTATCGCGACCGTATTCAGCA GCCAGGGCCATTATTTCTTGGATGCCAGGACAGCCGCGGTCCCGTTTGAAGCCTATCCTGCTGCCTTGAGCGACAGCATCGTTGAC GCGATCAAAAGGATTGGACGAGAGGAAGCCTGGCGACCAGGCGAGGCCGTCAGGTTGGTCTTTCACGCCTTCACCCAGTTGAGCCG AGAAACCGTTCAGGCAGTGGAGAGAGCAGTAGCAGGCATCGGGGCCACCAACGTAAGCTTCGCGTTTCTGCACGTTGTCGAAGATC ACCCGTTTACCATGTTTGACCGAGCGTGGCCAGACGGAAAGGCGACATTCGCCCCTGAAAGAGGTCAGGCGCTTCGACTCTCCGAG CGCGAATGGTTGTTGACACTTACCGGCAGGCGCGAAGTTAAGAGCGCCAGTCACGGGCTGCCTGGGCCGGTTCTGTTGCGACTTCA TGACAGCAGCACCTATAGAGACATGCCCGTGCTCGTCCGACAAGCATCCGACTTCGCCTTCCACTCTTGGCGCAGTTTTGGACCCA GCGGACTCCCCATCCCGTTGGTTTACGCGACGAAATTGCAAACAGCTCAGCGGCTTGGAAAGAACCCCCGGATGGGACACGGAT GCGGCTGAGGGTGGCCGGGTTATGAGAAAGCCTTGGTTTCTGTAGTAA |
| 124 | ATGCCTAAGAAAAAGCGCAAGGTTGAGGACCCGAAAAAGAAGAGGAAGGTCGGCAGCGGGAGCATGCAGCTGAACTACTTCCCCAT AAAGTTTGAGTTTGAAGAGTACCAGATAAAAACTGAGCCCTACAGCGAAGAACGACTTAAAGAGTTGAGGGCCAGTTACAACGCCA CCCACTCCTTTTTAGAAATGGAGACAATATATGCATTGAACAAGGAAGGCGAGGACATTAGTCTGACCGGCGAGGTGATACCG AAAAGAATTTTCGACGACAGTCAAGTGACCGCCTCATTGATAAAGCACTTGTTTTTCAGGACGTTCAAGGAGAGGTTCCCCAACTA TATTCCTGTGGACTTTTACCCCTTCCGCTTCTTCTCCGCCCAGGCTAAAGACGACATCATCTATAACGCCCTGCCCGGCAACCTCC GGAAACGAATCGCTTACAAAAAGCTGATCGAGGTTCAGTTGCGGCTGACGGAAATAAACGGCATCAAGCAGTTTGGCTTCCTGATC AACATTAAACGAAATTGGGTGTTCAACAAGTCATGCTTCGAGCTCCATCTCCGAGGGCTACAACCTGATCGGGGTGGACGTGCTGTA CGCCGAGGAACTGCCGGGGTTGACCGAGGTGCTGGCCCCAAACGAAGAGCTTTTGGGCGTAATCGCGGAAATCGTGGACGACAATG CCAGGATAGAAACCAACGAGGGCATTAAGGAGTTCCCTCTGAACCAGTTGTTCATCAAGAAAAGCAAGTACAACATTGGCAATTAC CTTAGCTTCGCGATCTCTCAGCAAAAGAGCGACGAAATAATGAATCTTATCGAGAGCAAACGCTCCGACATCTACAATACCAAGGG TCTTTACGACGAGATCTTGAAAATTGCGAACCATCTTTTTGCGAGAACAGCATCCAATATCCGAGAAATCCAGGCCTATAGCATCGCCGACTAC GCTTTACTGTCGATTCCCAGCCGCTCAGTGTGACGAACAGCATGGAATTGAAGACTTCCAACATTCATATCGATCCAGCGGCCACG AAGACGAATTCTAGCAATCCCGACTTGGGCCTGTCCAATTACGGGCCCTACGACTCCAGCATTTTTGACATAAAGATACCCAACGT GTTGTGCATCTGCAATAGGAATAATCGAGGCAACTTTACAAAGTTTCTGTCTAACCTGAAAGACGGGATACCTCAAAGCCGCTATT TCCAGAAAGGCCTCCAGAAGAAATACGACCTCCAGGATGTGATCCTCAATATCCGAGAAATCCAGGCCTATAGCATCGCCGACTAC CTTAACGCCATCAGGGACTACGATGAGAACAAGCCTCATCTGGCGATCATCGAGATCCCTGCCAGCTTCAAGAGGCAGGCCGACGT GGCGAACCCCTACTACCAAATTAAGGCCAAGTTGTTGAGCCTGGAGATTCCCGTGCAATTCGTTACCAGCGAGACCATCGGTAACC ACAACGAGTATATCCTGAACTCTATCGCGCTGCAGATCTACGCAAAGCTCGGCGGGACCCCGTGGGTCCTGCCCTCTCAACGCAGC GTTGACAAAGAGATAATCATCGGAATAGGCCATTCCTGGCTTAGGCGCAACCAGTACGCTGGCGCAGAACAGAATAGGGTAGTGGG GATCACGACCTTTATGAGCTCCGATGGCCAGTACCTTCTGGGTGACAAGGTCAAAGATGTTGCCTTCGAGAACTATTTTGAGGAGC TTCTGAAAAGCCTGAAGCAAAGCATCCAGAGGCTCAGCACAGAGCAGGGCTGGAGCGATGGCGACACCGTGAGGCTGATATTCCAC ATATTCAAACCGATAAAGAACACTGAATTCGACGTGATCAGTCAGCTTGTCAGAGACATCACGCAGTACAAGATTAAGTTCGCATT CGTAACCATCAGCACTGTGCACCCTTCCATGTTGTTCGACATTAATCAGTCCGGTATCGCCAAATACGGTTCCAATATCATGAAGG GACAATACATACCAAACAGGGGCCAGCAACGTTTTCCTGGACGAGAAGACATGCATCGTACAGATGTTCGGCGCGAACGAACTGAAA ACGGCCAAGCAAGGCATGAGCAAGCCCATCCTTATAAACATTCGCACCCCCCAGGGGAACTACAATTCAAGCGACCTGAACGATCT CCTGTTTTATGACCTGGGGTACATCACACAACAGATATTTAGCTTTACCTACCTCAGCTGGCGGTCCTTCTTGCCCGGTGAAGAGC CGGCGACTATGAAGTACAGTAACCTCATTTCCAAACTTCTCGGGAAGATGCGGAACATCCCTAACTGGGACGCCGACAATCTTAAC TACGGCCTGAAACGGAAAAAGTGGTTCCTGTAGTAA |
| 125 | ATGCCCAAAAAGAAGAGGAAAGTGGAGGATCCAAAGAAAAAGAGAAAGGTGGGTAGCGGAAGCATGACCGAGGCCTTCCTCACAAC CAGGAGGGGCTTCGTGCAAAAGCTGACGCTGACCAGGTACGATTACCTGAACTGGATCATCGAGTCCGAGGCGCAGAAAGCCAAGC TGAAGAACTGGCTTAAGAACAAGAGCGGGTTTTCTGACCCACAGATCGAGGATACCTGTTTCTTCACCTTCGAGAGGCTTCTGGAG GAGAGTACTAAGCAGTATAGAGCCTCCGGCGAGAAAATCTGTCTGCCCCGTTCAAGAACACGCAACTGATCTCAAATCTGATCGG TACCATATTGAAAAGGAGTTGAGCAAGAAATACAAGCAATTCTTTAGTCAAAACATCTTCATCGTGAGCACCATCGATCTGTATC CATTCAATCTCTTGAAGGCGTTCGAGTTCAACATCGAAGTGTTTGACAGCGGCCACTTCCTTATCCACGTCAACCCAGTGTCTAAA ATTGTAAGCAGCAAGGTTGTGACAAGGAGTATCTGGACTACCTCAAGGAAGGCAACCTCAACAACAGCAAAACCACCGAGATGGA GTTCGCGGTGATCAACCATGAAAGGAATTTCAGACTTAAATTCGACCTGCTTGACGAATGCATCTTTGAGAAGATAGAGAAGCTGC ACAGCGAGAAGAATATGTTTACAGCCACTTTTGATTACCATTTCCTGGCCAACTTCAGCCCCGAGATCTTCGGCAAAATCGTGGAA CATACTAGCAAGGATCTGAAGCAGGCCATCATGTTCCTGAATGACATACTGAGCAATATCAAGCTGCCGAGCTTTCTCAACCTGCA CGAGGAACGATACTTTAAGGTCAATATCTCCGAATTGGACCGAAAGAATAATCTTCTGATTGGAAGCAGTTTCGAGGTAATAACCA TATACTCAAAAAGCCAGACCCAGTATGGACTGAGGATTGAGTTCACTCGCGACAGCATAAGCCGGGACGAGCTTATAACAATCTTT |

TABLE 17-continued

Argonaute nucleotide sequences containing 2X Nuclear localization sequence (NLS) from Simian Vacuolating Virus 40

| SEQ ID NO | Sequence |
|---|---|
|  | CTGAAAAACGAAGAGCTGATCGAGAAACTCAACGACATTAAAGTGGTCCCCGCCACCATCAACGCAAAAATCGAACAGAAGACCGG CTGGAAAAACCCCTACATCACCAATGTTTTCATCGATAACGTGGGTGCCTTCAGCACCAGCAGCCTGCAAAGCGCCTCATCTTCC ACGGCATCTACAAGGCGTTAACAACTGGAATATCCTGCCCATCGTGTACGAGGACCTCGACATCAAAGTATTCGAGAACCTGATG CTGCACGCCTTTAACAAGAACGCCACCGAATTCAAGATCCTGGAACCCATCATAATCAAGTCCACGAACGAAATCGACAAACAGGA GGTGCAGAGGAGCATCAAAAACCAGGCCGGCAAGACCATGATCGCAGTGTTCTGCAAGTACAAGATACCCCATGACAGCTTCGCCC CCCTCAAGGGCTTCAAGTATCAGATCTATCAAGGCGACACCACGGACAATAAGCAGAATAGGGCCAAACTGAGTAACTTCACGTGC AAGTGCCTGGAGAAAATGGGAGGGGTGATTGCGGCAATCGCGGACACAAGCATAGCCGAGGATGGATATTTCATTGGCATCGACCT TGGCCACACCACAAATGGCAAGGAAAAGTTCTCCAACCTCGGAGTGAGCTTGTTTGATAGCTGGGCATCCTGTTGGGCGATTACG TGGAGAAGGAGATTCCAAGAAGGGAAAACCTCATCGACACGAACTGCCTCAATGCTTTTAAGAAACTTGACAAAATGCTGGAAGCT AAAAAACTGAACAAGCCCAAACACCTGATCATCCATCGGGACGGCAAACTGCACTTCAAGGATATCAACATTCTCGTAAGCTGCGT GGAAACCGTGTGGGGTAAGATAAACGTCGATATAGTCGAGATCATTAAGAGTGGCTTCCCCGTGATGGCTATAAAGGACGAGACCA ACAAACCAATCAATCCCATAAGCGGGACCAGCTACCAGGACGACATCCATAAGTACGCCATACTCGCCACAAACGTACAAGCCGAC GACAGTCAGCCGTAATAAACCCGATAATCATAAAACACAAATACGGAGAGCTGGAGTTTAGCAAAATAGTTGAACAGGTGTACTG GTTCACGAAAGTGTATACCAATAACCTGTACAATAGTACCAGGCTCCCAGCGACTACACTCAAGGCCAACAACGTGGTTGGCACGT CTAAGAAGCTCCACAGAAGTACATACTTGGGCTAGTAA |
| 126 | ATGCCCAAAAAGAAACGGAAGGTGGAGGACCCTAAGAAAAAACGAAAGGTCGGAAGTGGCAGCGTTCCAGTGTACCTTAATCGGTT CCTGCTGGACCACCTCACATCACCCTTGTCCTTGCCGGCGTTTCGGGTCGAACTGGACCCTCCCCCTTCCAAAGATGAAGTGCACC CGCTCCTGGCTCTCGTCGGTCGGGAAGCGGGAGGGCTCGTGAGGTTCCAGAACAGGCTGATCGGCTGGGAGGCTCCACGGGCCCTC GAAGGTCAGGTTAGGCGAGGCAAGCAGTCATATAGACTGGTGCCCCTTGGCCGGCAGGCACTCAATCTTAGAAAACCCGAAGAAAG GCAGGCGCTCGAGAATTTGTATAGGATCCGACTGGAAAACATCTTGAAAGCCCTCGCCAAACGACATAGGGCTAGAGTCGAACGCA GGGGCAACGGCCTTTTTCTGTGGAGGCCAGAGAATCCCCGAGAGGAGAAGGAGGGGTGGCACCTTTACCGGGGAAGCCTGTACCGC ATACATCTCTATCCTGACGGCGAAGTGATACTTGAAGTCGACGGCAGCATCGATTTCAACCCACTCTCCATCTCGAGGAGTGGCT GCAACGAGGCTATCCACTCCCTAGGCGCGTGACTAACGCCTACGAGGACGAGAAAGAATGGGCACTCCTGGGCATCGAAGAGGGA AGGATCCCCGCTCTTTTCTCTTGGATGGGGGCGAGTCATTGCTTGACTACCATCGCAAGAAGGGACGATTGGCAGAGGGCAGGAC CCCGGTCGAGTGGTCTGGGTTGCTAGAGGTAAAGAACGCGAGCGGATCCCACATCTGAGCGTCTTGTTGAAGCCAGTCATCACCAT GGAGCTGCTGGCCGGAAGTCGCTGAGGTCACGCAGGAGGCCTTGCCTGCGCTTCAGCTCGAACCCGAGGAACGGCTGAAGGACATTA GGCGCTTCGCTGAACCTGTACTGCAAGCGTTCGGCAAACGCGAAACTGCAAAACCCCTTGAAGGCAGAGCCCAGCGATTGCCGCGA CCCAGTTTGTTGGCACGGGGAAAAAGCGAGTGGGCAAAGTAGCGGACGTACTCGAAAAGGGGAGCATTGTCACCGGGCGAGACACG GTTGGCCCTGCTCGCATGGAGGGAGACGGGAAGGCCAAAGGCGGTCTCGCGTACTTGGAGGAGAGGCTTCAGGGCGTCGGGTCTG CATCCGGCATCAAACTTGAACTTAAACGGCGATTTCTGCCCCGAGGCGATAACCTCGAAATGGCACAGGTGTTTGAGGAGCTCTCC CAGGAAGGAGTAGGTGCCGGTCTGCTTCTGACTCCGCGCCTCACAGAAGGGGAAAGACGCGAACTGAAAAATACTGCGGCGACCA TGGGCTCGCTCTCCAACTCCTTAACCCGTTTGACCCTGGCGACATCTACAGGGTGAATAACGCTCTGCTTGGATTCTCGCGAAGG CCGGGTGGCTGTTCCTGAGACTGGAGGGAACTTATCCGGCCGACCTGGTGGTGGCCTATGACGCAGGCGGGGAGAGTCTCCGATTC GGCGGAGCCTGCTTCGCCCACCTGACTGATGGCACGCATCTGGGGTTCAGTCTGCCAGCCGCTCAGGGTGGTGAACGGATGGCCGA GGAGGTCGCGTGGGAGTTGCTGCGACCCCTGCTGTTGAGATACCGGAAAGCGAAGGCCAGCACCAGGGAGGATCTTTCTGCTCC GCGACGGTAAGATTCAAAAGGAAGAGTTCCGAAAAGTGGAAGAGGAACTGAGAAAGCGCAATATTCCCTACGCGTGTTTAGCGTC CGGAAGACGGGGGCTCCCCGACTGTTCAGCAAAAATGGGCCGCTCGGTGACGGTCTTTTTTTGCGACTGCCAGAGGAGGAGGGCGG GTTTCTGTTGCTTAGCGCCGAGGGTGGGAAGGGCACCCCACGGCCGGTTAAGTATGTGTTGGAGGCGGGAGAAGTGGACCTCAACC TGGAGGAAGCTGCCAGGCAATTGTATCACCTGAGTCGCATCTACCCGGGCTCCGGTTACCGATTCCCCAGGCTGCCCGCACCGTTG CATATGGTTGATAGGATGGTGAGGGAGGTTGCACGGCTCGGCGGCAGCCATAACTTGAGACTCAAAGAAGAACAACTGTTTTTCCT GTAGTAA |
| 127 | ATGCCGAAGAAGAAACGAAAGGTGGAGGACCCAAAAAAGAAGCGGAAAGTGGGGAGTGGCAGCATGTTCGTGGAACTGAACGCCTT CCCCATCGACATCCGCAATATCGGTATCGTGGAGGCCTGCGAGGTGCCGTACGACAAGGAGGTGCTTTATAGCCTGCATGATAACC CACAAAAAGATTACCATGCTATCAGAAACGGCAACCAGATATTGATATTTTCTAATAGCAAAAACTACCCCATCCAGGGTACAATC AAGGAGATAAATCTTGCACAGGACTACCGCATCCTGTTTTTCCTTATTAAGGAGTCCATTATCAAGATCCTGACGCAGATCAAACG GGAGCCTTTCAAGTTCAACCCGATTGAGTTCATCTCACCAAAGGAGAACATCACCGGAAATATCCTGGGAATCAATTACCCATTTC AAATAAACGCCAAATATTCAATCGATACCAGAATCATTCAGGGGGTGCCTGCCTCACCATTGATTGCAGCACGAAGAAATACAAC AAGGAATCCCTGATCTACTTCATTAACGACGGCTTCAACCTGATTAACAGGTACGTGATCTCAAAGCAAAACGAGAAGTATAAGCG CGTAGGTAAGATACTGAGCATTGACAACAACATCGTGACTGTTCAGAGCTGCGACAAGATAAAGAAGTACTCCGCCGAGGAAATCA CCTTGGAGGCGAACTCTAAGAACACCAAGGACTATCTGGCATACAAGTTCCCCTATAAGTTCGAGCAGATCCAAGAAAGCATTAAG AAGGCGATCAGTACCTTCACCCAGGGGACCTCTAAGCAGATAAACATTGGCAAGATCTGGGACTTTTTCAGCCAGAAAGGCATCTT CCTGTTCAACGGCCACCGAATTAACATAGGGCTGCCTCCCGACATCTCCCAGCAATGCAAGAACCTTGTGTACCGCGCTTTTTCT TTAGCAACTCCCGAGAAAACAATTCCAAAGAGAACGGCCTGAAGGATTATGGCCCTTACACCAGGAATTACTTTGACAGGAATAAC CCCAGCATTTGCGTGATTTGCAACGCTAAGGAACAAGGCAAAGTGGAACAGTTCCTGCACAAATTTCTGAAGGGCATACCCAATAG CCATAACTTTAAGACGGGCTTCGAGGGCAAGTTTCATATTGGCCTCTCAGATAGAATTTTTCACGACCAGCGACGACAGCGCTGG GCAGCTACCAGTTGGCTATCCAGAAGGCAATCCAAACGAGGACTAACCAAAACTCTAGCCAGTGGGACCTGGCCCTGGTGCAAACC AGGCAGTCCTTCAAGAAATTGTTGGTGGAGCAGAATCCGTACTTTATTAGCAAGAAAATGTTCTTTCAGCATCAGATCCCCGTTCA AGACTTCACCATCGAGCTGACCAATCAGAACGACAAAAACCTGGAGTATTCTCTGAATAACATGGCTCTGGCGTGCTATGCGAAGA TGAATGGAAAGCCCTGGCTGCTTAAATCAAGCCCTACTATCAGTCATGAGCTGGTTATTGGCATCGGGAGCGACAACATCATCATC GAGGAGGACAGTCTGAACGAGGATCATGGGCATCACCACCGTGTTCAGCGGCGACGGGTCTTACATGGTCTCAAACACTAGCAA GGCGGTGGCGCCCAATGAGTACTGTTGCGCCCTCATAGACACACTTGAGCAAACGATCAAGAAGCTGGAGAAACTTATGAACTGGC AGAGCAATGACACCATTAGGCTCATCTTTCATGCCGCCGTGAAGACCTTCAACAAAAATGAAATCCTCGCCGTAAAGGAAGTGATC AAAAAGTATAGTGACTACAAGATCGAGTACGCTTTTCTCAAAATCAGCCAGCGACCACGGCTCCGACCTGTTGACCACTCAACTAA GAATGAGAATAAGGGTAAATTGGCTCCCAAGAGGGGTAAGTATTTTGAACTGAGTAGCCATGAAATTTGCTGTACCTCGTGGGGC AGAAAGAGCTGAAGCAGGTGAGCGATGGCCACCCCCAGGGCGTGATCGTGTCCCTGCATAAGGACAGCAGCTTTCAGGACCTTAAG TACCTCTCTAATCAGATTTTCAGTTTTAGCTCCCACAGTTGGAGGAGCTACTTTCCCTCTCCCCTGCCCGTGACAATTCATTATAG CGATCTCATCGCGGAGAACCTGGGCTGGCTTAACAAGCTGAGCGGCTGGGACGATACAATCCTGCTGGGCAAACTTGGACAGACCC AGTGGTTTCTGTAGTAA |
| 128 | ATGCCCAAGAAAAAGAGAAAGGTCGAGGACCCGAAGAAGAAGCGAAAGGTAGGAAGCGGTAGCATGAAAAGCAACTTCTTCCCCAT CCAGTTCAACTTCGACGACTTCCATATCCAGAGGCTTCCCTACCAGAAGGAGGTGCTGGACAAGCTTCGGCAACAACACAATGCGA CCCATAGCTTTTTCCGCAGAGACGATTTTATCTATATTAGCCCAGGGGTAGAGGCCGCAGCGAACCTGGGAGACGTAGTACGCCTC |

TABLE 17-continued

Argonaute nucleotide sequences containing 2X Nuclear localization sequence (NLS) from Simian Vacuolating Virus 40

| SEQ ID NO | Sequence |
|---|---|
| | TCTATTACCAAGCACCCCGAGGTCGTTGCTTCTCTTGTTAGGCACATATTCTTTAGGACAATCAAGGATAAGGTCCCCGGTCTGCT<br>GCCAAGCTTTCACCCATTCACCTTTCCCGCCAAACAGGACAAATACGATCTGGCCCTGAACATGCTCCCCGAGCGCCTGCAGAATG<br>TTATCACCTACAAGAGGATAACCGAGGTACAGCTTCGATTCAACGAGACCGAAGAGCAACCCCAGTTCGTCGCCGTAGTTAACCAC<br>AGGTACCAGTGGACTATCGACCGAACTTGCGAGCAATTGGTAAACGAGGGTCTGGACATCCTTGGCCTGGAGGTGAACTCTAGTAC<br>GAGCCCTGATTATTCAGACGGAGTTGTGGCACCAGAGCTGACACTGTTGGGCAGGGTGATGGCCGTGAACGGGGATCACGCCACAG<br>TAGGGACCAACCAGGGTCCGACAGAGTATGCCCTGTTCGAATTGACCTTGTTCAAGTCCAAGGAGAACATAGTGAACTACCTTGGA<br>TCTTTGGTGGGCGAGGGTAAAGCCGAACAAATAGTCAACCATATCAAACAAGATGAAAGCAGAAGGCTGCAACCGGACGTTGTGAT<br>GAGGGAGATCGAGGAAATGGGAGTGTGGCTGTCTAGGCTGGCCTACAGAAACTTTGACTCCTTTTGCTTCACCATCGGAACGAACA<br>ACGCTGTCAGCGGCCAAGCAGGTATCAGACTGGAGGAGCCAAAGCTGATATTTGACGTCTCAGGTACGAACATACACGCTACCCCC<br>ACAACCGGGCTCAACACCTTCGGCCCCTATAGTAGAAGCACGAGTTTCGACGTTAACTCTCCGAAGATTCTGGTTGTGTTTCACCA<br>GCGGAACGCAGGCCACTTCGCAGAGTTTCTCGCACAGCTGAAGGGCGGCATCGCTCAGCACGCATACTTTGCTAACGGGATGGTCA<br>GGAAGTATGGTCTCACGGCAATGGAGTACCGGATTGCCGAGATCACTGACTACACCGTGCCCCAATATCTTACCGCCATCAATAAG<br>CTGCTTAGGGCGGAGAACGGAAGCTTTGACATCGCCATCGTGGAGACCTGTGAGGATTTCCGGAGGCTGCCTCCCATGGATAATCC<br>GTATTTTCAGGTTAAGAGTTTGTTGTACAGCCATGGAATCAGCACCCAATTCATCAGAGCGGAAACCGCTCAGAAACCGATTTATT<br>CAATAGATAGCATCGCGCTCCAAATGTACGCCAAATTGGGCGGAACACCATGGACGGTGCCAATAGGGCCGAGCGTAGATCACGAA<br>TTGGTGATAGGCATCGGTAGCTCCATATTGCGCAGCAACCAGTATGCAGGTGCAACCCAAGCTCGAATAGTGGGGATTTCTACCTT<br>CTTCAGCGCCGACGGGAAGTACATAAGCAATAGAAAGACCCAGGACGTGCCTTACGATCAGTACTTCGATGAGCTCTTGCATAACC<br>TTAAAGTCTCCATCGACGAGATTTCCAATAACTACAGCTGGAGCTCAGGCGACCGCATCAGGATCATATTCCACATCTTCAAGCCC<br>ATAAAACACATCGAGGCAGACGTCGTCGCAAGCCTGATGGAACACATCGACCAGGAGTTCGATATAAAGTTCGCTTTTGTGACCTTTAG<br>CGAGTTCCACCCGTATGTGCTGTTTAATGAAAATGAAAGGGGGGAATTTGATGCGTATAGGAAGGTTTACAAGGGCACCCATGTAC<br>CGTGGCGCGGTTACAATGTTCGCTGGATCCTCGGTCATGCCTGGTCCAGATGCTGGGACCCCATGAGATGAAGACCAGCCGGCAC<br>GGCGCTTCTAGGCCCGTCCTTGTGAGAATCCACCGCAGTTCTACGTTTGTAGACCTCGCGTACGTCGTGCAACAGGCCTTTAAGTT<br>TACTAGGCTCTCATTCCGCACGTTCTACCCTGTGCATAGCCCTGTGACGCTGCTCTACAGTAATATGTTGGCCCGACAGCTCAAGG<br>ACCTGAGGGGCATTCCGGGTTGGAACTACGATGTAGCTAGCAGGCAGTTGAGGCACAAGAAATGGTTCCTGTAGTAA |
| 129 | ATGCCGAAGAAGAAGCGAAAGGTCGAGGATCCCAAAAAGAAACGGAAGGTTGGCTCCGGGTCTATGGGCAGGCAACTCCAACTGAA<br>CTTTACCCCGCTCAGGGTTAGGGGCGACGCCATCAGACTTCAGGCGCTGCCTTTCGAGGACGCTCAACAATTTAGGAATCTGCGCG<br>ATGAGCATCGAGCACACTACGCTGTGACGAGAAGGAGCGACCACATCGTGGCCCTCCCACTTACACTGAATGCCTCCCCAATCGGC<br>GAGGAGAAGATCGTGAGCGTTGTGGAGCATGCGAGTTTGATTCGGCCCCTGCTTGAACAGAGGTTGGTGACCCTTCTGTCCAGTAA<br>CCGGAGGCCGGTGGCCCGGTATAATCCGATCACCACCATTGGAAGAACCTTGCCAACGGGCTTCATAGAAGCCGACCGACACCTCC<br>ATTTGCAGTCCCGCGTGCTTATTGCTATCCGCTCCCTCAAGCTGCCGGACGCCGAGCCCTTGGGATTGCTCTGGGACATCGAAATC<br>CAGAAAACATGCGCGACTAGCCTTGCGTCCTGCACGCACAAGGGGTACGGCTGGACGGTCTCACAGTGGAACGGCTTGTCCGGT<br>GGAGGACGTGCGAATGTTGCCTTATAGGCGACTGGTGGGCAGAGTAGGCGCGCTGACCGATGGCCACGCCCGATTGAGCGAGCGGT<br>TCCAGAACGTCGAAGAATTGCTGCCCCTGGACGAGCTTTACCTGGAGGCCAGTCCGGAGAACCTGAGGCACCTTCTGCAGCATTTC<br>ATGCGCAACACAAGCGGGCGAGTGCAAGGGAAGATAGACGAGATCGTCTTCGAGAACTCACGGGACGCGCTCGGATGGAGCACAT<br>TGCCCGGATCTCCGACTGGCTTAGAGGCCTGGGCGAGATTGAACTGCGAGGAGGGTTTGTCTGTAGGCATCGGAAACCTGCTCTCTG<br>AAAAGGACGCCCAGAACTTTCCCAGGTTCACTGAGGGAACGACCCCAACCTACGTGTTTGACGCTGGGACGTTGAAGAGCGAGTCA<br>AGGGCCGCAGTGGGCCTCAGTAAATTCGGGCCCTACAGCCGGCATGTATTTACACCGACTCGACCCAACGTTTGCGTCATCTGCGA<br>CCGCGCAAGAAGAGGACAGTTTGAGCTGTTCCTGCGGAAATTCCGGGATGGCCTGACTGTTGATGGGAAGTCCCTGCCGTTTGGTC<br>GCGGGTTTCTGGGAATATATGCCTTCAGGATATCAACCTGACCTTCGTCGAGCGGGATGCATTCACCGCGGACGCGTACCATGCT<br>GCCGCAAGCAAGGCAGTACGGATGGGAGCCGAGGGCGCACCGTGGCACCTGGCACTCGTGCAAACAGAACGCGACAGTCGGCAACT<br>GGCTCCCCCAAGAATCCGTATTTGGTAGCGAAGGCGGCGTTTCTGTCTAATCAAATTCCTACCCAGTTTGTGGCGTTCGAGACAT<br>TTTCTATGGCGCCTCTGAACCTCGCGTACACACTGAGCAACCTGGCGTTGGCGGTTTATGCCAAGTTGGGCGGCATCCCATGGCTG<br>ATCAAGAGTGATAAAGGTATAGCCCACGAGGTCGTCATCGGGTTGGGTAGTGCCGCGATCGGGGAGTCCCGATTCAGCCGGAAGGA<br>GAGGATTGTCGGCATCACAAGTGTTTTTCGGGGTGACGGCGGGTACCTCTTGTCTAACCTGTCCAATGCCGTGCCCATGAGCAAGT<br>ACGGCGAAGCATTGACCGAATCTCTCCAGGCGACCCTGCAGAGGGTTCGCAATGAGATGAACTGGATCAGGGGGGACAGCGTTCGG<br>GTCATAGTTCACGCTTTCAAGCCAATGAGGAACACGGAGGTGGAGAGCGTTAAGGCTGCGCTGAAAGAATTCAGCGAGTTCGACCT<br>GCAATTTGCTTTCCTTCACGTTAAGCAAGACCACCGTACCTCCTTTTTGACGACGACAGCATCGGTACAAAAGGGCGAGGCGAGA<br>AAACCCCCGTGCGAGGCTTGTTCGCGGAGGTCGGACACAACGAGACACTGCTGACCCTGACCGGACCACAGCAGCTGAAGAGACCC<br>ACCGACGGGCTGCCGAAACCGCTTCTGCTCAGCCTCCATAGGGACTCTACTTTCACAGATATAATCTACCTCACGAAGCAGGTGTA<br>CTGGTTTAGCAATCACTCATGGCGGTCTTTCCTGCCAGCAGCGATGCCGGTGACGATATACTACAGCGACCTGGTGGCTGGTTTGC<br>TCGGAAGACTGGATAGGCTGGGGTCTCGCTGGTCACCGAGTGTAATGCTGGGCAAGATCGGAACCACAAGATGGTTCCTGTAGTAA |
| 130 | ATGCCCAAAAAGAAGAGAAAGGTGGAAGATCCCAAGAAAAAGAGGAAGGTGGGTAGCGGGAGCATGAGGGAAACCAACATCTACGA<br>GCTCAGCGGCCTCGAAACCGTGAGTACCAGCTACAGACTTTTCGAGTTGCAGGGCGCGCCAGAGTTCTCTCCTGAGTATTATGCTG<br>GTGTGAGCCGCTCGTGAGGACGCTTAGCAGGAGACACCAGGCACCCTTCACCAGTATCCAACGGGGCGAGACCATGTTGCTCGCT<br>GCACCCGAGGCCCTGAGCGGTGATCTCGCAGAACACCATAATCTGGCACGCTGGGTGGCGACCCTGAAGTCACTTGGAGATAGCAT<br>AGAGATAGACTGCAGCGTGAGCGGAGATGAGCTGGACCCCATAAGGCTGCGATTCCTGAACTTCATGATCCAATCTTCCATTGTTCA<br>ACCACGGCGAGCTCTGGCAGCCCAGGGCCGGTGATGCCTTCTACTACCGGAAGCCTGCCGACACGTTCGACGGAATGAACTGTTT<br>GAGGGTATTGCCGTGAGGGCCGTGCCCTACCCAGGAGGCGGGTTCGGCGTTATGCTCGACGCGAGGACTAAGCTGATCTCACAGCG<br>GGCTGTGGGCGCCTACGCGGACCCGAATTTCATAAGGAGGCTGAAAACATCTTAGCTGCCTCGTACCGAATGGGAGACATCTGGTACG<br>AGATAAAGATCAGTGGCGCGAATCAGACCGTTTCTCACCCCATCCTGTTTAAGGACAACCAGCCCGTGCACTCAAAGCCTACCTG<br>CACGAACAAGCACGGCAGCCAATCCCCAAGTCTCTGATTGATCTTAAAGGTGACGGCGTGGTGTTGACCTATCGCGGCAGCGATAG<br>CGCCGAGGTCAAAGCGGCACCCGCGGAACTTTGTTTCCCCATAGTAGACACCCATAGCAAGAGGGGGTGCCCGGCACCAGAGAAGGA<br>GCATCCAAGCCCCACACATCCGACGCAGCAAGGCTTACCGATTCAAGCAAAGGTTCTTGCGGGACATCAAAATAGGAAATGCCGTG<br>TTGAGCGTGGCCGACCAACCCGCAGCCCTCAAGACCAGGCCCATCGACTTGCCCGAGCTGCAATTCGGCTCCAATAGGATTCTGTA<br>CGGCACGGACAGGGCGGAGACCGAATCGACCTTCGCCAGTATGCCAAGAATCGGCGAACGCTGCTGGAGCGCGCAGACGTGGGCT<br>TCTTTGAGACTTCTCCCCTGGAGCCCCAATGTTTGGTACTTCCTAAGAGCGTGATGAACGCATGGGCAACGAGTTCGTTCGAGAC<br>CTGACTGCCGAAGTGAAGCGACTCCACCCCACCGGTAACTACAAGCCAACCGTAATCGCGTTTGATGATGTCAGCGAACGATGA<br>CGCCAGGAGCCAAGCAGAAGCCATCTTCAAGCTCGCGGAAGACGGGGATCTCCCTCCAGGCGACTGCGCCATTATGATACACCGAA<br>CCAAAGGAAGGCAAGAGCGCAGGAGGAGCTGCCCGCACTTCTTATAAACAAGCTGAGAAAAGAGCTACGGAGTGAATGCCGCCATA<br>TTCCACGCGACTGTCCCCGGCAACGCCTACCGAAGGGAAAGCGCCAGCGATGGCGCTCGCTATGTGCGCAAGCGGGATGAGAAGGG<br>CAGGTTTAGTGGATACCTGACCGGAGCGGCGCTTAACAAGATTCTTCTGCCCAACGCCAAGTGGCCCTTCGTGCTCAAGGACGAGT<br>TGGTGGCAGATATAGTGGTGGGCATAGATGTGAAACATCACACCGCAGCTCTCGTTTTGATCGCCGAAGGCGGGAGGATTATCAGG |

TABLE 17-continued

Argonaute nucleotide sequences containing 2X Nuclear localization sequence (NLS) from Simian Vacuolating Virus 40

| SEQ ID NO | Sequence |
|---|---|
|  | CACACTCTTCGCCTCAGCACCAAGAACGAGAAACTCCCTGCTGGTATCGTGGAAACGAAGCTGGTGGAACTGATTTCAAATGAAGC<br>ACCACACCTGAGCAGGCTCACCAAAACAATCGCCATCCATAGGGACGGCAGGATTTGGCCCTCCGAGCTTAAGGGATTGCGAGCAG<br>CCTGTAGGAAGCTTGCCGACGACGGCCACATCGATCCTGCGTTCGATCTGAACGTCTTCGAGGTGAGCAAAAGTGCCCCTGCTAGG<br>CTTAGGCTGTTTAGCGTCGACCGCAGTGCTGGCAGAAAGCCGAGGATTGAAAACCCGGAACTGGGGGACTGGATGATGCTGACAGA<br>AACCGACGGCTACGTTTGCACGACCGGTGCTCCGCTGTTGAGAGGTGGTGCGGCTAGACCCCTGCATGTAAAGCAGGTCGCAGGTG<br>ATATGAGCTTGCAGGACGCCCTTTCCGACGTGTTCCGACTGAGCTGTCTGACCTGGACTAGGCCCGAGTCATGTAGCAGGTTGCCT<br>ATCAGTTTGAAGCTCTGCGATATGCTGCTGATGGACGAGGGAACTGCCCACGACGAGGACGAAATCCTTCATGCTAACGACGACAC<br>CCCAGCCGTTAGCGCCTAGTAA |
| 131 | ATGCCCAAAAAGAAGAGAAAGGTAGAGGATCCCAAGAAGAAACGAAAAGTAGGCAGCGGCAGTATGGTCGCGCTGAGGCTGAACGG<br>CGTACCCATCTTGTGCGCCGCTGACGTAACCGTGGCCGTGGCGAAGTTGCCGTACACGAAGGAGAGCCTGGACGAGTTGAGGAAGG<br>AGCATGCGGGGAGGTATTTGATTAGGAGAGGCGGAGATGACGGGCAGGAAATCATGTCTGTTCCCTTGCTTGCTGATGCTCCGCAG<br>CTGAGCGATGCCGTTGTGGAAGTTAAGCTGTCAGAAGCCCACTGGTTGCTCGCCTCACTCGCGGTGGAGGCCCTCACCAGGTTGTT<br>CACAGAACTTGGTAGACCTATCCTGCGGTCCCGGCCATTGCGGCTGCTCTCCCAAAAGCCGGCCAATCTTTTTCCGGAGAACGTCG<br>GACTGCCAGACTGGCTGCAAAGGAGGGTTGTGCTGGATTTGGAGACTAGGAAGATCTGGCGGCAGGATGGAGACCCGACATTGGTG<br>CTGCTGTGCGATGTGCGGACTCAAAACTTTATCGACGTGCCAACGGATAAACTGATGGCCACCGGCGTAAGCGTTATGGGTCGCTA<br>CGTTAGCCGAATGGTGAGCTCTGATGATCCCCGGATCACCTCACATCTGAAGCTCGCCGGCAGGGTCATTAGCATAGAGGGCGACC<br>GACTGCTCCTCGCCGACTTTGGCGAGGGACCGGATAGTATAAGCATTGCTCATGCCTATCTGGAGAGACGACGGGAAAATGTCGAC<br>TGGTGTGTTCAACAGCTGAACCCCGCGAAAGCAGGGCAAATCCTGATGAGCGTGCAGGCCGAGCTGCGAAATTCTTGAACGGACC<br>TGGCCGATTCGAGCTGATCAAGAGGACATTCGATTACCTGCGCACGCAGAGTATAGAGCTTGTGCCCGACGTGAAGCTGGAGTTGG<br>GGGACTTGATTGGCATGGGAGCCGACGCTGGCCCTTCCGCCAGGAAACAATTAAGAAGCCTACCCTGGTGTTTGATCCGTCTGGT<br>GTCAAGACCGATACCTGGAACGAGCGAGGGCTTGACAAACACGGACCCTACGACCAGAGGACCTTCAGCCCCAAGGAAATGAGGAT<br>CGCCGTTATCTGCAGGGAAGCAGACGAAGGTCGGGTTGAAGGATTTCTGGCCAAGTTTCTGGACGGGATGCCACACGTTATCGTCG<br>GGGAGAACCGAAAACCCTATGAAAAGGGATTCATAAGGAGGTTCGCCCTGAGTGCCCCGAAGGTGCACACTTTCACCGCTAAGTCT<br>TCTAGTGTGCCGGACTACCTGAATGCGTGCCGAGCGGCCCTGAAGTTTGCCCACGACCAAGGCTTTGAATGGAGCTTGGCAATCGC<br>GCAAATCGACAAGGACTTTCGGGAACTCCTCGGTCCTGACAATCCCTACTTCGCGATCAAGGCCGCGTTTCTCAAGCAGAGGGTGC<br>CCATCCAGGAGTTGACGCTCGAGACAATGAGCACCCCCGACAGGCAGCTGGTGTACATTTTGAATAACATAAGCCTCGCAAGCTAC<br>GCCAAGATCGGCGGCATTCCGTGGCTGCTTAAGAGCGGTCCTACCGTGGGCCACGACTGGTCATTGGTATTGGTAGCCAGACCGT<br>TAGCAGTAGTCGATTGGGCGAGAAGCAACGGGTGGTGGGCATTACCACCGTATTCACCCACGATGGCAGATACCTTTTGGACGACA<br>GGACGCGAGCCGTGCCATACGGCGAGTACGAAGCAGCTTTGTCCGAGACGCTGACCAGGGCCATAGAGAGGGTAAGGACGGAAGAT<br>AACTGGAGGTCAACCGACGCGGTGCGACTTGTATTCCACGTGTTCCAGCAAATCAAAGACTACGAGGCCGACGCAGTGGGGAAACT<br>GGTCGAGAATCTCGGCTTCAGCGATGTCAAGTACGCCTTTGTGCATGTCGTTGACAGCCACCCCTACACCCTGTTTGACGAACACA<br>TGCCAGGCGTTAAGTTTGGCTACGAGATGAAGGGCGCCTACGCACCTGAGAGAGGCCTGTGCATCAGTCTTGGCAGGGACGAACGC<br>CTCCTCAGCTTTACCGGGTCTAGGGAGGTTAAACAAACCCATCATGGCCTCCCAAGGCCAACCCTTCTTCGACTGCATAGGAACAG<br>TACCTTCCGGGACATGACCTACATCGCCAGGCAGGCTTTCGACTTCGCAAACCACTCATGGAGGATGCTCACCCCAGCGCCCCTCC<br>CCATCACCATCCACTACGCCGAACTCATCGCCCGGTTGTTGGCTGGTCTGAAAGACACACCCGGCTGGGACGAGGACACAATGCTC<br>GGCCCAGTAGGTAGAACCCGATGGTTTCTGTAGTAA |
| 132 | ATGCCTAAGAAAAAACGCAAAGTAGAAGATCCTAAAAAGAAGAGAAAGGTCGGCTCCGGGAGCATGGATTACATACTTGAATTCGA<br>CGAGTTTATTCGAAGCATCAAGCAGAATATTGATACAAAGTATTCATTCCTGTTGGGGGCTGGCGCTTCAGTCGAATCAGGTATTC<br>CGTGTGCCAGCGAATGCATCTGGGAGTGGAAGAGGGATATCTTCATCAGCCAAAATCCGACCCTGGCTGAGATGCACAACAACATC<br>AAGAGCCAGAACATTAAGCGCAGCATCCAGAACTGGCTCGATAACCAGGGCACCTACCCAAAGGAGGGCGAGGACATCGAGTATTC<br>CTACTATATTGAGAAGGCTTTCCGGATTCCCGACGACCGGAGGAAGTATTTCGAACGAAACATCACCGGCAAGACTCCGTCACTGG<br>GCTACCATATCCTGTGTCTGCTGGCGGAACGCGAGATAATCAGGTCCGTTTGGACAAATCTTCGACGGCTTGATCATTAAAGCC<br>GCCCATAAGTACCAGTTGGTGCCCATCGAGGTCACCCTCGAGAGCCAAGATAGAATCTATCGGACGGATCCAACAAGGAGTTGCT<br>TTGCATAGCCTTGCATGGGACTACAAGTACGGTCCGCTGAAGAATAGTAAAGAGGAGCTGGACAGCCAGTCTGACATCTTCGTGA<br>ATGCCCTTTCCTTCGAGGCGTCTAAGCGCTATTTTGTGGTGATGGGATACAGTGGGCGCGACAAAAGCCTCATGCAGGCTATTGAG<br>CGAAGCTTTTGCAGAAGCGGCGCTGGCCGCCTTTACTGGTGTGGATGCGGCGGAACATCGCGCCTGAGGTACGCGTGCTGATCGA<br>GAAGTTGAACTTGTATGACGCGAAGCGTTCTATATTCCCACGGACGGGTTTGACAAGACGATGTTGAACATAGCCCATATGTGTT<br>TCGAGGATAAGGAATTGCAGGAAGAAGTGGAGAAACTCAAAGCGGATCTCGGTGCGGGTATGAGTGTCGCACCACCACGTTCAGC<br>CCCTACAAGGAAGGGGTGAATAAGATCGTGGACACAAATGTTTACCCGATCAAATTCCCCGACAAGTGCTATCAGTTCGAGGTGAA<br>GAACAGCAGCGTAATGAACCTCTGGGATTACTGCAAGCAGCTGATAGACTATAACATTGTGGCCGTCCCCTATAACGGAATGATCT<br>ACGCCTGGGGAAACCGCAACAGCATCAGCAACATGTGCGGACCAAATGTGAACGGGACGATCGAACTCGTTCCTCTCACTAGGAAA<br>ATCTTTTTCGACAACGGCACTCTCAAGTCAATGCTCCTTAAAACTTTGCTCATCGTGATTGGAAAGCACTCCAATTGCAAGTATAA<br>CCGAAACAAAATCTGGCGAGAGTCCAAGAAAATCAACTACACTATTAACGGCAAAAACATTGAAGCGTACCAAGGCATTAGGTTTA<br>GCTTGTTCATGGACTGGAAATACAGCTACCTCACCCTGACCCCCGCTTTCTACTACAAAGACAGGACCAACGTTAGCAAGGAGGAG<br>AACAAAGAGTTCAGCGACCGGTTTATGGAGCAAATATGTAAGATGCAAGCCAATAAGAATTACGCCGCTGCATAAAACACTGGAT<br>TAACATTATCTTTCCTGATGGCAAGTCCATCATTTCCATGTACCCGTGTAACAGCGAGAGCGGATTCGAGTTCACCATTGTAATA<br>AGTCACTGCTGGTCGGACTGCGGAGTAGGCAAGCACTGCATAATCCTGACGATGACATGAAGAACGGATTTGCATCGGTGGAGCT<br>GAGTTGGCGGACACCGAGCTCAAGTTCTACAATCCGGCTCAGAATGCAATGCACACCGACTTCCACCCCATGAGGGGCCTTATCAA<br>CAATAAGCCCTACGACTTCTACATGAATAACAGGCTGTTTAAATCTAACATCTCCCTGGGCGTGATCTCTCCTGTGGGTTCAGAGA<br>AAAAGCTGGAGGACTTCCTGGACCGACTCAACAAAAAGCACAAAGTGAACTACAACGTCGACTATGTCATAGATTATCCTGGGTTT<br>CAGTCCGTCTACGGGGTTGGCCTTTCGTCCCTCTGATCGCAGAATGGGCGTTGTTGGATGATAAAATGCTGAATAAAGCCAACCT<br>GTATCAGAGCTGCCTTAACTTCGGGGATCAGATCAAGAAGAAGATTGAGTACCTGAAGAGCCGCGACAGCGTGGACGTGATCATCA<br>TATACATTCCGAAAGAGTACAGACCTGTTCACCTTCTTCAACGACGAAATATTCCATTATGACCTGCACGACTACGTGAAAGCATTC<br>AGCGTGCAGAGGCACATTAGCACCCAGTTCATACGGGAGAAAACAATTGACTCTGAGCTTGACTGCCAGATCGCGTGGGCCCTCAG<br>CCTGCTATCTACGTTAAAGCAGGCCGCACTCCGTGGATTCTCAGTGGCTTGAGGACTGATACCGCCTTCGCCGGCATCGGCTATA<br>GTGTGGACCATATAAAGACCGACAACCAGACCCTTATCGGCTGTAGCCATATTTACGGGGCAGATGGCCAAGGTCTCCGGTACAAG<br>CTCTCCAAGATTAAGGATGTGACCTTCGACAGCAAGAACAATCCCTACCTGTCCGAAAACGAGGCCTACCAACTCGGCGTAGAATAT<br>CAAGGAACTTTTCTTTGATAGCTTCAAGACGTTGCCCCAACGAGTGGTCATACACAAAAGGTTTCCGTTCCAGAAGCAGGAGATCG<br>ATGGCCTGACTAAGTGTCTTGGGTCCGCGGGAGTGAAAGACATAGACCTCATCGAAATCACCTTGGAGGATCGATTTAGGTGCTTT<br>GAATACGACAGGCGACTCCAGATTGACGGCTACCCCGTGAGGAGGGGCGTGTGCTTCGCCATCAACGAGAACACCGCCTATCTGTA<br>CACCCACGGTATTGCACCAAGCGTCAAGAATGCCAATCTCCGCTACATACAGGGCGGTAAGAGCATCCTGCCCCCCTGAAAATCG<br>TTAAGCACTACGGGAACGGCGACCTGGCCCAAATTGCGACAGAGATCTTGGGCCTGTCAAAGATGAATTGGAACAGTTTTGGTCTG |

TABLE 17-continued

Argonaute nucleotide sequences containing 2X Nuclear localization sequence (NLS) from Simian Vacuolating Virus 40

| SEQ ID NO | Sequence |
|---|---|
| | TATAGCAAGCTTCCGTGCACTATCCAATCTAGCAACGCTATCGCTCGCGTAGGGTGGCTGCTCTCCCAGTATGAGGGCGTAGTTTA<br>CGACTATAGGAATTTCATGTAGTAA |
| 133 | ATGCCCAAAAAGAAGAGGAAGGTAGAAGATCCAAAGAAAAAGCGGAAGGTCGGGAGCGGGTCCATCACCAGCTACCCTTACGCTAG<br>GAACAAGGCCGACATGATTCGCAAGGTTAATTGGAATCTGATCGTGTTCGACGAAGCCCACAGGATGAGGAATGTCTATAAGAAGT<br>CCAATAAGATCGCCCGAACCCTGCGCGAGGCCACTGCCGGCTATCCCAAGATCCTGCTCACTGCAACCCCCCTCCAAAACTCCCTC<br>ATGGAGCTCTACGGATTGATATCTTTTATTGACCCCCACATCTTCGGGGATGAGACAACTTTCCGCAGACAGTTTAGTCGCGGCAC<br>CAAGGAAATGAGCGAGATGGACTTTATCGACCTGAAACAACGAATTAAACCCGTGTGTCACCGCACCCTGAGGCGCCAAGTCACAG<br>AGTACGTTAACTACACTCAGCGCATTCCGATCACCCAGGAGTTCATGCCCACCAACGAAGAATGGGAGCTGTACGAGAAGGTCAGC<br>GCCTATTTGCAACGAGAACATCTCTTCGCGCTCCCCGCGTCACAACGAGCACTTATGACCTTGGTAGTGCGCAAACTGCTCGCCAG<br>CTCTTCATTTGCTATTAGCGATACCCTGCTGAGCCTCATCAAGAAGTTGGAACAACTGCTGGAACAGCTGGCTCCGGCAAGACGG<br>AGATTACCGTAGAACACAGCGATGTCTACGCGGACGTGGACGAGTTTGATGATACAGTGGAGGAGTGGGAGGAGGACGACCAGCCT<br>TCTTACATAGATAAACTGAGCCCAGACGAGATGAAACGGTTGATTCAGGAGGAAAAGGAAGAACTGGAGCAGTACTACAGCCTTGC<br>AAAAAGCATTAAAGAGAACTCAAAGGCTGAGGCCCTCCTCATAGCGCTTGAAAAAGGGTTTGAAAAGCTCAGGATGCTGGGGGCTA<br>ATGAGAAGGCCGTGATCTTCACAGAATCCCGACGCACACAGATGTATCTGAGGAGAATTCCTGGAGAGAAACGGCTACGCCGGGAAG<br>ATAGTGCTGTTCAACGGTGAAAACCAAGACGAACAAGCGAAGCAGATCTATGAGCAGTGGTTGGAGAAGCACCGACACGACGACAA<br>GATTACGGGCTCTAAGACGGCGGACATGCGAGCCGCGCTCGTGGAGTACTTTAAGGAGCAGGCTAGTATAATGATAGCGACCGAGA<br>GCGCCAGCGAAGGCATCAATCTGCAATTTTGCAGCTTGGTTGTGAACTATGACTTGCCATGGAATCCGCAAAGGATAGAGCAACGG<br>ATCGGGAGGTGTCATCGCTATGGTCAAAAGCACGACGTGGTGGTAATAAACTTTCTCAATTGTAAAAACGAAGCGGACAAGAAAGT<br>AGATGAGATATTGTCCGAGAAGTTTCGGCTGTTTGAGGGCGTATTTGGCAGCAGTGATGAAGTCCTGGGGTCCCTCGAAAGCGGCG<br>TGGATTTCGAGAAGAGAATCCAACAAATCTACCAGACCTGCCGAACCGCGGAAGAAATTGAGCAAGCGTTCAAGAACCTGCAAGCT<br>GAGCTCGACGAGCAAATTCAACTGAAGATGAAGGAGACCCGAATGCATCTTTTGGAAAACTTCGATGACGAGGTGAGGGAAAAGTT<br>GCGAGACCATTATCACCAAACCTCCCTGCATCTGAATAGGATGGAAGGGTATTTGTGGAACCTCAGCAAGTACGAGGGGGCACGCG<br>AAGCCATCTTTGACGACGAGACGCTGTCCTTCGTGAAGGACTACGAGACCTATCAGATGATCAGCCAGGCGAAGAAACAAAACAGT<br>CCAAACGTGCATCACTTTCGATTCTCCCACCCGCTTGCGCAGAAGTGGATCGAACAGGCCAAGAGCAGGGAATTGTTGCCAAAGGA<br>GATAACGTTCAGGTACAGCGACTACAAGGGCAAAGTCTCCATCTTGGAAAGACTCATCGGCAAGGAGGGTTGGTTGAGTCTGGACC<br>TGCTTCACGTCCAGAGCCTTGAGAGCGAACAACACCTCATCTTTGACGCTGCCATCGACCATCGCGACCCGAGGGCGGTCAACTGGACCAGGAGATG<br>TGCGAGAAAATGTTCGAGCTGCCCGCTGTGGAGGGCGAGGAAGTAGAGATATCCGACTCCATCCGAAACACATTGAGACGAATCTC<br>AGAGGGCCAGCAAGAGGCAATACTGAATGAGATTATGGAACGGGCGTCCGCCTACCTCGACTCAGAACTCGAGAAACTGGAAAAAT<br>GGTCACAGGACCTCAAGAATAAGCTGGAGAAAGACATTGATGAAATGACGGTGGAGATCGAGCATCTTAAACGGGAAGCTAAATTG<br>ACACGCAACCTGGCAGAAAAACTCGAAAAAAACAAACAGATCAAGGAGCTTGAGAAGAAGCGCAACGAAATGCGCCGGAATCTCTA<br>TGACCAACAGGACGAAATCGATGAACAAAAGGACCGCCTCTTCGAGGAGGTAGAGAAAAAACTTGAACAACGGACTGCGACGGAGC<br>ACCTCTTCACTATCAAATGGCGGATCGTGTAGTAA |
| 134 | ATGCCTAAGAAGAAGAGGAAGGTCGAAGATCCCAAAAAGAAACGAAAGGTTGGATCAGGGTCTCTTCACCTTAACTACCTCCCATT<br>GCGCTTTACCGCCGATATATTCAAGGGTGGTGCTTTGACATTTCCCGAAGGCAGCGAGAAAAACTGGACCAGCGACGATCCAATCA<br>GCAAGGAGCTGAGCAAGTTGCGAGAGAAACACGGAGATAGTCATGTCTTCCACCGGATGGGAAACAAAATTGCATGTATCCCCGTT<br>GTGGAGAACGCCATTGCTATAGGCACCGAGACGGATTTCAACATCATTAGTGACTTTCAGCTGGCTAATGCTCTTGCTCGCAGCGC<br>CCTCCACAGGTACTTCAAAGCTGCGGGAAGGGAGACTGTAATTGGGTTCCGACCCGTAACCCTTCTCTTGGAAAAACACAACTTGG<br>CCAGCAACAGGAGGACGTGTTCGGCATTTTCCCGAGTACACTCTGGACGTCAGGCCTCTTGCTCCACCACATGAGGGCGACATAGCG<br>AGCGGAGTGCTTATCGGCTTTGGAATAAAGTATGTTTCCTTCAGAACGTAGCCGAGCTGCAGGCACAAGGGGTGAGTGCCGCAGG<br>GATGTACGCCGTGAGGCTGGTAGACGAGAGCGAACATCAATTTGACCGGGCCTACCTGGGAAGGATTGATCGGTTCACAAAAGATA<br>ACGTGACGCTCGTTGACAGCGATTACGCGGAATATCCCGCCGACCAGTGTTACTTCGAGGGAAGCAGGACCAACATCGAAGCCGTG<br>GGCCGAAGTCTCCTGGGGAAAGACTATGATGCCTTCAGCTCAAGCCTTTTGCAGGGAGGTACAAAGTGACCGGAGCCCCCAACCA<br>AACCCAACGACTGCACCAGTTGGGCGCGTGGCTCGAGGCCAAGAGTCCGATCCCCTGCGCCGTTGGTCTGGGAGTACGGATTGCAA<br>AAAAGCCGCATGAGTGCTCACGAGGCAACGACGCCGGGTACAGCCGCTTTTTCGACAGCCCCAAGTGCGTGCTGCGGCCTGGCGGC<br>TCTCTGACCGTGCCCTGGCCGGTCGACAAGCAGATAGATCTCAATGGCCCTTACGACGCTGAGAGCTTTCCCAACAAGAGGGTACG<br>AATTGCCGTCATCTGCCCTCAGGAATTCACCGGGGATGCCGGAAGAGTTCCTCCGGAAGTTGAAGGAGGGCCTTCCTAACGCACCGG<br>ACGGCAGTCCGTTTCGCAAGGGCTTTGTTCGAAAGTACCATTTGTCTAGCTGTGACTTCACGTTCCATGAGGTTAAGCGGAGCTCA<br>AACAGTGACGACATCTACAAGGATGCGTCCCTTGAGGCACTGAAGCAGAAGCCAGATATGGCAATCGCCATAATCCGGTCCCAATA<br>TCGCGGGCTGCCCGATGCTTCTAATCCCTATTACACGACAAAAGCTAGGCTGATGGCCCAGGGCGTACCAGTTCAACTGCTGAACA<br>TAGAGACCATCAGGAGGAAGTCTTTGGACTACATTCTGAATAACATCGGTCTTGCGATGTATGCCAAACTTGGAGGAATCCCTTGG<br>ACCCTCACCCAGAATAGCGACATGGCGCACGAGATCATCGTCGGGATAGGGTCAGCCCGGCTCAATGAGAGCAGGAGGGGTGCTGG<br>CGAGAGGGTCATCGGGATCACGACCGTGTTCAGTGGTGACGGACAGTACCTCCTCGCCAACAACACCCAGGAAGTTCCCAGCGAAG<br>AGTACGTAGACGCATTGACTCAGTCTCTTAGCGAGACAGTATCAGAGCTTAGGAGCCGGTTCGGTTGGCGCCCTAAAGATCGAGTG<br>AGGTTCATATTCCACCAGAAGTTTAAGAAGTACAAAGACGCAGAGGCGGAGGCGGTTGATAGGTTTGCACGCTCACTGAAAGATTT<br>TGACGTGCAATACGCCTTCGTGCATGTGTCTGATTCTCATAACTGGATGCTGCTGGACCCAGCTAGTCGGGGGTGAAATTCGGCG<br>ATACGATGAAGGGCGTCGCCGTCCCTCAGCGGGGACAATGTGTGCCCCTGGGGCCAAACGCTGCGCTGCTTACTTTGAGCGGTCCG<br>TTCCAGGTAAAGACCCCACTGCAAGGCTGTCCGCACCCCGTGCTGGTGTCAATTCATGAGAAGAGCACTTTTAAGTCTGTTGATTA<br>CATAGCCCGCCAAATCTTCAATCTCAGCTTCATCAGTTGGAGGGCTTTAACCCTAGCACCCTCCCAGTGTCCATTTCCTACTCCG<br>ACATGATCGTAGACCTCTTGGGACATCTTAGACGCGTTAAGAATTGGAATCCGGAAACCCTGTCTACCGCTCTTAAGGAACGAAGG<br>TGGTTTCTGTAGTAA |
| 135 | ATGCCCAAGAAGAAGAGAAAAGTGGAAGATCCCAAAAAGAAGCGAAAGGTGGGTAGTGGGAGCATGAATTTCCAGCTGTGCGACCA<br>ACGCAAAGCCATTATCGCCGAACCAGGCCATCTGTTGGTCCTGGGGCCAGGAAGCGGGAAACTACCGTCGCCCTCTTCAAGG<br>CCAAGCAGAGATTTAGCACTCTGAAACCTAGCCAAGAAATCCTGTTCCTGTCATTCAGTAGAGCTGCCATCAGGCAGGTCCTGCTG<br>CGGTGCAAGGAGATTCTGAAGCCCGCAGAGAGACGCGCTGTCGCCGTTCAAACCTATCATAGCTTCTGCATGGACATGCTGAGGGC<br>GCACGGTAGACTGCTCCTGGGCCACCCCGTGCGATTCATGTATCCCGGCGACGAGAGGCTTCAAAAGGCCGCATTCGAGGGGGACT<br>GGGGAGCCGAAGACAAAAGGCAAGCCAAAGAGATGGGCATCTTTTGTCTCGACCTTTTCGCGCAAGCGCAGCTGAGTTGCTCGAG<br>AGGTGTGCCGCACTTAGGAAGCTTATAGGGGACAGCTTCCCCATGATAATAGTGGACGAGTTCCAAGCACACGACGACAACCAATG<br>GCGGATCGTGGCGCAACTTGCCAAGGTAGCGGACATCTTCTGCCTTGCCGACCCCGACCAGAGGATCTTTGACTACGAGACGACA<br>TCGACCCCCTTCGGATCGAGGGTTTGCGGACCACTCTTGCCCCCAGGGAGTTCGATCTTGGCGGTGAGAATACCGCTCCCCGAAC<br>GCAGGGATATTGAACTTCGCCAACGCTGTGCTGCATAACCAGAGCCCCCTGCCCGATACCAGCGACATCATGCAACTGCGGTACTG<br>GCCTAGAGCGTTCGCGAGCACCGTGCATGCCTGCGTAGTGTTTACCTTCAGCGAACTCAGGAAACTGGGCGTGGAGAACCCCAGCG |

TABLE 17-continued

Argonaute nucleotide sequences containing 2X Nuclear localization sequence (NLS) from Simian Vacuolating Virus 40

| SEQ ID NO | Sequence |
|---|---|
|  | TGGCAGTGCTGAGCCGATCCAACGGGCTTATCAGCGATGTGAGCGCCATACTGGCTGAGAAGCACGCGTACAACGGGAGGGAACTG<br>CCAATCGTGGAACACGACGTGGTTTGGGACGCGGAGCTGTCTGCGGCAGCAGCCGTCGTCGTTGCGTCCACCCTGGAGTGGCCAAC<br>AGCCGCTGCAGAGGTTGCTGTTGCCAGGACACTTGCGCTCATAGCAGCCTATTACAAGCTGAAGAACGCCGAGGAACCCACCAAGA<br>GCGCGGCTGAGGCTGCCCAAAAGTACGAGGCGGCTGCAAGCAAGGTGGCCAGTGAGGAGACCCCAAGGATCAAAGCCGCGAAAGAA<br>TTGCTGGCCGCTCACCAAAGTGGCATCCAGATGGTGGGCGACCCGGTGGCCGATTGGAAGTCTGCGAGGAGGGTATTGCAAGAGAT<br>AAGCGCCCTGGGTGAGTTGTACAGGGAGGTCCGGCTCGTGAGGTTGTTCCGGGCAACCGACGCCTTGGCTTCCGGCCTGAGCAATA<br>GGTGGTTGGCTACTGGAAGCTACGAGGGCGTGTCCGACCTGGTGAAGGGCATCCTTGAGCAGGAGAAACTGATTGCCGTGGAAAGG<br>GACCCAAGAGGCTGTATACTGATGAACATCCATAAAAGCAAAGGTAAGGAATTCGACGGCGTGGTACTCATTGAGGGGGCATTTAA<br>GTCCCATTTCTTCGATGAGCGGAAGGAAGTCAGCCCCTATGAGAGGTCCAGACGGCTCCTGAGAGTCGGTCTGACCCGCGCTAGGC<br>ATAGGGTGACAATCCTTAGACCTCAGGGAGCGAGGCCCCTTGTGGATCCCATCTAGTAA |
| 136 | ATGCCCAAAAAGAAACGAAAGGTAGAAGATCCCAAGAAAAAAGGAAAGTGGGAAGCGGAAGCATGGAGAACCTGGCTCTTAGTGC<br>GCTGCAACTGGACTCTAAGCTCGACCGCTACATCGTGTGCAGGTACAGAATCGTGTACCAGAAGCGAGACGAGACCATTCCCGGCG<br>AACAGTTGGCCCGGAAGGCGGCCTACGAGATCCAGAAAGCGAATGACTTCGCCCTTTTGACCAACCTCGGCAATAACACATCGTT<br>TCCCTCAAGCCCATCTCACAGAGGGGCATTGAAAGCACCCACCTTCAGCGAATCTCATCGAAGACGGGGACCTGGAGCTCGATTG<br>CTCCATCGAACAACATCAGCAGGCACTCCAGCGGCTCGTGAACCAGGACATCAATAAAGCTGCGTGGAAGCTTAAGAAGAGCTCAC<br>AGGGCAAACTCGATTACAAAAAGGCAGCTAGCGGGAACACCGAGATCTTTGAGCCAATTCATAGCACTCGAATCAACGCCCGAGCC<br>ACGTATCTTGACGCTTTTTGCTCACTGCAGCTTAGCCCCGAGGTGCTTGCTAATGGAACCGTACTGATAGGGCTGCATCTCAAGCA<br>CAATCTGGTAGCAAAGTCTGACATCTCTTTGCAGTGGATCATTGATAAAAGGCCCGATTGGCTGCAGGCATCAAGAAGGTGCGGC<br>ACAGGTACTTCGATCCCGGCAAAGCGCCCCTGGTCGCCGAATTCCTGAGGGTGGAGGACTCCCTGAATGGCAACAGCGTCTTGCCC<br>CACATGGGCCAGAGTCTTGTTTCATACCACCAAGCGAAGGGACTCTTGTCAGAAAGACAGCTCGCAGAGGCCACGAAGAGCGTGCT<br>GATAAAGGTAAAATACGGCAAAAACGAGGCGGACCACATCGCATCTCTGGTTGAACCAATGTTTGATTTCGACACGCTCAGCAAGA<br>TCGATAGTATCTTCCTTAACAAGTTGGCAAAGGACCTGAAGTGGAGCCTGAACGACAGGATACGCACTTCCGCGAAATGGTGAAA<br>GGCTTGTATCTCCCAAACTTCAACTGCAAGCTGGAACAGGTTGACTATCAGATCCTTCACAGGCAGCGACTTAATCACCAACAGAT<br>GCTTCAATTCGCCAACGGGGCGAAATCTTCAAGAGAGCAGGACGTGCTGCGACATAAGGCGTTCGGCAACATGACGCGCACACAAG<br>TTATCCCGCTTATTGCGGGCGAGAAGAACAATACAGAACAAAATAAGCAGCTCCTGTGCAACGCATACCAAGCATTGCAACAACTG<br>ACCACCACGGAATTGCCTCCGTTCACCAAGTTCCCCAACCCCGTAGAGAACGCAGCCGAGCTGGACGCAAGACTGAATGAACGGTG<br>TCCCCCAAATGCGATACTGCTCATCGGCCTTATCGACAAAAGCGACAAAGTGGCGATCCGCGACACCGTTTAGCTACGGTCTTG<br>CAACCCAGTTCATGCGCCTGGATCACAGACCGAACGTCTACAGCCCCTCATATTTCAACAACGTGGCGGCTGGTTTGTTTTCCAAA<br>GGTGGCGGGCAGCTCTGCGCCATTGATGACATGCCGGGTGAAACCGACTTGTTTATCGGTCTCGACATGGGAGGGATCTCTGTAAG<br>GGCACCAGGCTTGCGTTTCTGTTTCTGCGATCTGGTGCGCAGTTGGGGTGGCAACTCGCGGACAAACAACAGGGAGAAAGGATGC<br>AGGATGAGGCCCTGATGTCACTGTTGGACAAGTCTCTCACCACCTACCTGAAGAAGCTGCTCTGGTGAGCTTCTAAGCGCATAACC<br>CTCCATAGGGATGGCAAGTTCTACGAAAGCATAGAAGTGATCGAGCAGTTTGAGCAGAAGCACGGCGTGAAAGTAGATGTGCTGGA<br>GGTTCTGAAAAGCGGTGCTCCGGTTTTGTATAGACGAAGCCGCATGGCCGACGGAACCAAGGAGTTTAGCAACCCCAATGTGGGCG<br>ACGCGATCTATCTCAGTGATCATGAGATGATCCTGAGCACGTATAGCGGCGAAGAACTCGGAAAGATATGGGGTGACAAGGTCAGC<br>GTCAGGCCTCTTAGGCTGCGCAAGAGATACGGTGATGTGAGCCTGGAGACCCTGGCACATCAAGTGCTCGTGCTGTCTAGGATACA<br>CGGCGCTAGCCTGTATCGCCATCCTCGACTGCCCGTGACCACGCACCACGCCGACCGATTCGCAACACTGAGGCAGGAAACATGCA<br>TAGACGCCCTCTCTAAGATGGACCGGCTCTGTCCGGTCTACCTGTAGTAA |
| 137 | ATGCCCAAGAAGAAGAGAAAGGTCGAGGACCCGAAAAAGAAGCGAAAGGTAGGTAGTGGTTCCATGGTCGGCGGCTATAAAGTCAG<br>CAATTTGACAGTGGAAGCGTTCGAAGGTATCGGGAGTGTCAACCCGATGCTGTTTTACCAATACAAAGTCACCGGAAAGGGAAAGT<br>ACGATAATGTGTATAAGATTATCAAAAGCGCACGGTACAAGATGCATTCTAAGAACCGATTCAAGCCCGTGTTCATCAAGGACGAC<br>AAACTGTACACCCTCGAGAAGCTCCCCGGATATAGAAGACCTGGATTTCGCAAACATTAACTTCGTGAAAAGCGAGGTTCTCAGCAT<br>AGAGGATAATATGTCAATTTATGGCGAGGTGGTGGAATACATCTCAAGCTGAAAAAGTGAAGGTGTTGGGAAATACC<br>CCAAGTACAGGATCAATTACAGCAAAGAGATTCTCAGTAATACGCTGCTGACACGAGAGCTCAAAGACGAGTTTAAGAAATCAAAT<br>AAGGGTTTTAACCTGAAACGGAAGTTTAGAATTTCCCCCGTGGTGAATAAGATGGGCAAAGTGATACTCTATTTGTCCTGCAGTGC<br>TGATTTCAGCACCAACAAGAACATTTACGAAATGTTGAAAGAGGGCTTGGAGGTTGAGGGGCTGGCCGTTAAGAGCGAGTGGAGCA<br>ATATCAGTGGCAACCTGGTGATCGAGAGCGTACTGGAAACCAAGATATCCGAGCCCACTAGCCTGGGCCAATCCCTGATAGACTAC<br>TATAAGAATAACAACCAGGGCTATAGGGTGAAGGATTTCACCGATGAGGATCTGAATGCCAACATTGTCAACGTGAGAGGAAATAA<br>GAAGATCTATATGTATATTCCGCACGCGTTGAAGCCGATAATCACCCGGGAGTACCTGGCCAAGAACGATCCAGAGTTTTCTAAGG<br>AGATCGAGCAGCTTATCAAGATGAATATGAACTACCGATATGAAACCCTCAAGTCATTTGTGAATGACATCGGGGTCATTGAAGAG<br>CTGAACAACCTGAGCTTCAAAAACAAATACTACGAAGATGTGAAATGCTGGGTTACTCCAGCGGCAAAATAGACGAACCCGTCCT<br>GATGGGGGCAAAAGGGATCATAAAGAACAAAATGCAGATTTTTTCCAATGGATTCTACAAACTCCCCGAAGGCAAGGTACGATTTG<br>GCGTTCTGTACCCAAAAGAATTTGATGGCGTGTCAAGGAAAGCTATCCGCGCCATTTATGACTTCAGTAAGGAGGGCAAATACCAC<br>GGCGAAAGCAACAAGTATATCGCGGAACACCTGATAAACGTGGAGTTCAATCCAAAGGAGTGCATATTTGAGGGATACGAACTGGG<br>CGATATCACCGAATACAAGAAGGCGGCTCTGAACTTAATAACTACAACAATGTCGACTTCGTAATCGCAATAGTCCCGAACATGT<br>CCGACGAAGAGATAGAGAACAGCTACAATCCGTTCAAGAAAATATGGCCGAACTGAATCTGCCCAGCCAGATGATTAGCGTCAAG<br>ACGGCCGAAATCTTTGCCAATAGCAGGGATAACACGGCGCTTTACTACCTGCATAACATCGTCCTCGGTATCCTGGGTAAGATAGG<br>AGGGATTCCCTGGGTGGTTAAAGACATGAAGGGCGACGTGGATTGCTTCGTTGGACTCGATGTCGGCACCAGGGAGAAGGGCATAC<br>ATTACCCCGCCTGCAGCGTTGTGTTTGACAAGTACGGCAAGCTTATTAACTATTACAAGCCTAACATCCCGCAGAACGGAGAGAAG<br>ATTAACACAGAAATACTTCAGGAAATTTTCGACAAGGTGCTCATAGCTATGAGGAGGAGATGGAGCCTACCCGAAGAATATCGT<br>GATCCACAGGGACGGCTTTAGCCGAGAGGACCTTGACTGGTATGAGAACTACTTCGGTAAGAAAAACATAAAGTTTAACATCATCG<br>AAGTCAAAAAGTCAACTCCGTTGAAAATCGCCAGTATAAACGAGGGAAATATCACGAATCCTGAAAAGGGTTCCTACATCCTGCGC<br>GGCAACAAAGCCTACATGGTGACCACAGATATTAAGGAAAACCTGGGAAGCCCAAAGCCCCTGAAGATAGAAAAGAGCTACGGCGA<br>CATAGACATGCTCACAGCTCTCAGCCAAATATACGCACTCACGCAAATCCATGTGGGGGCGACCAAAAGCCTGCGCCTCCCAATCA<br>CCACCGGCTACGCCGACAAGATTTGCAAGGCGATCGAGTTCATCCCCCAAGGGCGCGTGGACAACCGCCTTTTCTTTCTGTAGTAA |
| 138 | ATGCCCAAAGAAGAAACGAAAGTGGAAGACCCCAAAAAAGCGGAAGGTGGGCAGCGGCAGCATGAACAATCTGATGCTGGAGGC<br>GTTTAAGGGCATTGGCACCATCAAGCCCCTGGTGTTCTATAGGTACAAGCTCATCGGCAAGGGAAGATTGAGAATACCTACAAGA<br>CGATCAGCAACGCCAAGAATAAGATGAGTTTCAATAACAAGTTCAAAGCGACGTTCAGTAAGGGAGAGACCATCTACACCCCTTGAG<br>AAATTCGAGGTCATGCCCAATCTTAACGATGTGACCATTGAGTTCGACGGAGAAGAGGTTCTCCCGATAAAAGACAATAATGAAAT<br>TTACTCCGAAGTCGTGCAATTTACATCAACAATAACCTTCGAAAGATCAAACTGGATAACAAATATCAGAAGTATCGAGCAACGA<br>ATACCAGAGAGATAACTGGCAACGTCATACTCGACAAAGACTTCAAGGAGAAGTACAAGAAGTCTAAGTCAGGGGTTCCAGCTCAAG<br>CGCAAATTCATAATTTTCCCCCAAGGTGAACGACGAGGGTAAGGTAACCCTGTTCCTTGACCTGAACAGCAGCTTCGACTATGACAA |

TABLE 17-continued

Argonaute nucleotide sequences containing 2X Nuclear localization sequence (NLS) from Simian Vacuolating Virus 40

| SEQ ID NO | Sequence |
|---|---|
|  | AAACATTTACCAGATGATCAAGGCCGGGATGGACGTGGTGGGGCAGGAAGTGATTAATACGTGGAATAATAAGAAGCAGAAGGGCA AGATTAAGAAGATTTCTGAGCTGACGATCTCAGAGCCTTGTAACTTCGGCCAGTCCCTTATCGATTACTACGTTTCCCTCAACCAA GCTGTGAGGGTGAAGAACTTTACGGAAGAGGAAAAGAACACAAACGTTATCGTCGTCCAGGTGGGAAAGGGCGAGGTTGAGTATAT TCCGCACGCGCTCAAACCCATCATTACTAGGGAGTACATAAAGAAATACGATGAGGCCTTCAGCAAAGAGGTAGAAAACCTGATCA AAATCAACATGTCATCACAGGTACGAAATACTGAAAAAGTTCATCGACGACATCGGCTCTATAACCGAACTGAACAACCTTAAGTTT GAGAACACGTACATAGATAACATCGAGTCACTGGGCTACCAACAGGGAAAGCTGAACGATCCCGTGCTGATAGGCGGCAAAGGCAT CCTGAAGGATAAGATACATGTGTTCAAATCCGGCTTTTACAAAAGCCCCATTGACGAAGTCAAGTTCGGCGTGATTTACCCGAAAG GCCACACCAATGATAGCAAGTCCACCATCCGGGCGATTTATGATTTTTGTACCGACGGGAAATACCAAGGCAAGGACAACATCTTC ATTAACAACAAACTGATGAATATCAAATTTAGCAACCAGGACTGCGTGTTTGAGGAGTACGAGCTCAATGACATAACGGAGTATAA GCGAGCCGCGAATAAGTTGAAAAACAACGAGAACATCAAGTTTGTAATCGCCATCATCCCCGCGATTGATGAGAGTGATATAGAAA ATCCCTACAACCCTTTTAAGCGGGTCTGCGCCGAGTTGAATCTGCCCAGCCAGATGGTAAGCCTGAAGACCGCGAAAAGATTCGGC ACCAGCAAGGGTAATAACGAGTTGTATTTTCTGCATAACATTAGCCTGGGTATCTTGGGTAAGATAGGGGGGGTCCCTTGGGTCAT TAAGGACATGCCTGGGGAAGTTGACTGCTTCGTGGGCCTGGATGTGGGCACCAAAGAGAAAGGGATCCACTACCCCGCATGCAGCG TCCTTTTCGACAAGTACGGCAAGCTGATTAACTATTACAAGCCCACAATCCCGCAGAGCGGCGAGATCATCAAGACAGACGTGCTG CAGGAGATCTTCGATAAAGTGCTGCTGAGCTACGAGGAGGAGAACGGCCAGTATCCTCGAAACATCGTGATTCACAGGGACGGGTT CAGCAGGGAGGACCTGGAGTGGTATAAGAACTACTTCATCAAAAAGAATATAAACTTCACGATTGTAGAAATCAAGAAAAACTTCG CCACCCGCGTCGCGAACAACATAAACAATGAAGTGTCCAACCCATTTAAAGGGAGCTTCATACTGCGCGAGAACGAGGCCATCGTT GTAACCACCGACATCAAAGATAATATCGGCGCTCCGAAACCAATCAAAGTCGAGAAGACATACGGCGATATTGACATGATGACCAT AATCAACCAGATCTACGCCCTCACGCAAATCCACGTCGGAAGCGCGAAATCTATGAGGCTGCCGATCACGACCGGCTATGCCGACA AAATATGTAAATCCATCGAATACATCCCGAGCGGTAGGGTGGACAACCGGCTCTTCTTCCTGTAGTAA |
| 139 | ATGCCGAAAAAGAAACGGAAGGTGGAGGATCCAAAGAAAAAACGCAAAGTTGGCAGCGGCAGCATGATAGCCGTGGAAGAGTGGCA ACCTGCGGACGGACTGACCCTTGAGCCTAATGCAAAGAGGGCTGGAAGGCTAGAAAGAGGTGCCTGGCCCTGACAGCGGGTCCCG GTGCCGGAAAGACAGAGATGCTCGCACAACGCGCCGACTTCTTGTTGAGGACCGGAACCTGTCGGTACCCCAAGAGGATACTGGCC ATCTCATTCAAAGTGGATGCAAGTAGAAACCTGAAGGACAGAGTGGAGAGGAGGTGCGGCTATGATTTGGCGTCAAGGTTTGACAG TTATACTTTCCACGCGTTCGCCAAAAGGATCATCGACCGCTTTAGGCCGGTGCTGACAGGCAAGGACGCCCTCGACGCAGGCTACA CCATCGTGGATAAGAAGAATGGCCCCTCTAGGACCCAGATCGAGTTCGGCGACCTTGTCCCCCTTGCCATACAAATCCTGCAATCA AGCAAAATTGCACGAAACGCGATCCGCCAAACTTACAGCGACATCTTCCTGGATGAGTTTCAGGACTGTACAAACCTGCAGTACGA CTTGGTAAAACTTGCGTTCCAGGGTACGTCAATACGGCTGACGGCTGTTGGCGATACCAAGCAGAAGATAATGGCCTGGGCTGGAG CCCTGGACGGCATTTTCCAGACGTTTGCCAACGATTTCAACGCCGTGTCCCTGAACATGTATAGGAATTTCAGAAGCAAGCCACAA CTGCTCAGGGTTCAAAATGAAATTATCAGGAAGTTGGACCCCGATTCCGTGATGCCTGACGAACAACTTGACGGTGATGAAGGCGA GGTCTATGCGTGGAGGTTCGAGGATAGCTGCAAGGAAGCCGTGTATCTTGCGGACCTTATCAATGGCTGGATCAACACCGAACAGC TGCCCCCAGCGGAGATCGCCGTACTGGTCAGCAAACAGCTCGACCTCTATGTCGACCACTTGATGACTGAGCTCGAGGCTCGGGGA ATCCCCTACAGGAACGAGCAGCAGCTTCAAGACATCACCATAGAGCCGGCAGCTAGACTCATTGTGGACTACTTGAGTTGCCTCTA CGGCAAGAGAGAGCCGAAAGCATGGATCCGGCTCATGAACCAGCTGATCCCATTCGCGGACGAGGAGATCCAATCTAGTGCTCGAA AGGACCTCGACCAGTTGATAAAGAAGCAGAGAAAAAGGGTGGCGCTGCAAGCCAAGCCACACAGCATTCACCTTTCAGCGATTGGGCACAA CTCGCAATTGAATTCCTGAAGTACATAGGCAGTAAGATGCTGGTGGCACTGAGTCCAGATTACGAGACGCGCGAGAGGCTGAATGA CGTGATCAGGGAAACTTTCGCGAGGATCAAGGAACTGTTGAAGAGCGAGCCCGACCTGCCCAAGGCGCTGGGCCGGTTTGCCGATG ACCAGGCGGTGCGAATACTGACCATCCACAAGAGCAAGGGCCTGGAATTCGACAGTGTGATCATCATGGCCGTCGAGAACGAGATA TTCTTCGGGAACCAGGACGAGAATAGGTGCGCTTTCTTCGTAGGTGTGAGCCGAGCAAAAAGGAGGTTGATACTTACCCACGCCGA CCAGAGGGAAAGGCCAGCGTCTGCCAAGCGATGGAATGTTAGTAGAACCGCTCAGACTGAGTACATTAGTTACGTCACCCCTTTCG TGAGGCCACAGTAGTAA |
| 140 | ATGCCGAAGAAAAAACGGAAGGTGGAGGACCCCAAAAAGAAACGCAAAGTGGGTAGCGGCTCAATGCTCGACTTTAGCCTTACCCA GAAAGGTTGGGTGCTGCCCATCGTACTGAACGCCTTTCCGCTCAAGGTACCGGACATGGAGCTCAAATTCGTGCAGATCCCCTACG ACAAGACGACCCTGGACTCACTGAGGTCAAGCCACAAGATGACCCACGTCTTCAGGAGGCAAGGCGACAGTATCCAGATCTTTTCT AGCGACGGCACCTTTCCAAAGAGCGGCACCCCCCAGACCCTCCAACTGAAGGATAATCTGGGAATCTTTTTCTCTCTTGTAAAGGA CGGCCTCCTCAAGCACTTCGCCGGTTTGGGCCGAACCCCGTGCGGATTCAACCCCATTGAGGTCGTGTCAGCTCAGGCCAAGACAA ATCTTCTGGCTAGCATCCTCGGAGAAGCCTACCCGCTGAAAATTTGCGCCAAGTACTCCATCGACACCAGGACAGTGCAAGGTCAA CCGTGTCTCATCATCGACTGCAGCACTAGGAGAGTGGTTAAAGAGAACTGCCTCTTCTTCCTTAAGACCGGCTTTAACGTGATTGG CCGCTATGTAGTGACCGAGCAGGACGACGGGTTTCGGAAGCTGCTGGGTTTTGTGGAAAACTGCCACGAAGGCAGGACACTGAGCG TTATAAGGCCAGATGGCCAAGCCGTGCATGCCGAGGCCAAGGACGTGTATCTCGAGGCATCTAGGGCCAACTTCGACGACTACATC CTTTATACGCACGGAACTAAAAAGGATAGCATCGTGGAGCGAATCAGACAAAGCGTGAGTATCTTCAACGGCGGTAAGAACAAGAA AGATAGAATCGACGCGCTCAAAAGTACATCCAGGCCACCAATATAAGCCTTTTGGATGGGACCAGGATCGAAATCGAGGAGCCCA GCGACATTCAGAAGGACTGCGCCCAGATGCAGAAGCCCGTGTTTGTGTTCAATGACAATGGCGAGGCCGACTGGACCGAGAAGGGG CTGACTCAGAACGGCCCCTACACCAAGCGCACCTTCGACCGAAACGACCCCAGCATCTGCGTGATCTGCGCAACACGACAGGGG GCGAGTGGAGCAGTTCGTTAGGAAACTGCTGAAAGGCATGGCTAACGACAAATACTTCAGAAACGGCCTTGAGGGCAAGTTCGCGC TGGGAACGTCCCGGGTAGAGGTGTTTGAGACCAGCACAAATAGCGTGGACGCCTATAAGAGCGCGATCGAAGCCGCCATCCGCAAG AAGGCCGATGACGGCGGCAGGTGGGACCTGGCATTGGTTCAAGTTAGGCAGAGCTTCAAGCAGCTGAAGGTGACTGACAACCCCTA CTACTTGGGAAAAAGCCTGTTCTACATGCACCAGGTGCCAGTGCAGGATTTCACTATCGAGCTCCTGAGCCAGTCCGACTATTCAC TGGGCTACAGCCTTAACAACATGAGCCTCGCTTGCTACGCCAAATTGGGAGGATTGCCCTGGCTGCTCAAGTCCTCTCCCACCCTT AGCCACGAGCTGGTGATCGGCATCGGCAGCGCCAACATTGTCCAGGAGAGGGGGGCACACAACCAGGATCATGGGGATAACCAC CGTATTTAGTGCGATGGCAGCTACATCGTCAGCAGCACGTCCAAAGCTGTGGTTCCCGAAGCATACTGCGAGGCGCTGACTAGCG TGCTGGGCGAGAATATCGAAAAAATCCAAAGGAGAATGAATTGGCAAAAGGGTGACTCAATCCGACTGATCTTCCACGCCCAAGTG AAGAAGTTCAACAAGGAGGATTCAGGCAGTGCGAGCCGTGATAGCAAGTATAGGGGACTACCAGATCGAGTACGCTTTTGTGAA AATCAGCGAGAACCACGGCCTGCACATGTTTGACAGCTCAACCGCCACCATGCCCAAGGGCAGGTTGGCCACACAGGGGTAAGA CCTTTAAGCTGTCCAAAAACGAGATGTTGGTCTACCTGATCGGACAGAGGGAGCTGAGACAGGAAACCGACGGCCACCCAGGGGT GTCATCGTGAACGTACACAAGGACAGCACTTTCAAAGATATCAAGTACCTGAGCGCCCAACTGTACTCTTTTGCGAGTCATTCTTG GAGGTCATACTTCCCCAACCCTATGCCCGTGACCATCACCTACAGCGACCTTATCGCCCACAACCTCGGCTGGCTGAACCAGCTGC CCGGGTGGTCTGACAGCGTAATGATAGGTAAAATCGGTCATAGCCAGTGGTTTCTGTAGTAA |
| 141 | ATGCCTAAGAAAAAGAGGAAGTTGAGGATCCAAAAAAGAAACGAAAGGTAGGCAGCGGCAGCGTAAAGCTTAATCACTTCCCCCT GAATCCCGCTCTTGCAGTGTTCAAGACTACCTACAGGCACAGAAACCCCAGGGGCTTCCTGGGATTCGTTAGGTCACAAGGGTTGA CCGCGGAGAGAGTTGGCGAGGAAGTGTGTGTCTATCACGGTCTTCCCCACCCGGCTTTTAGAGGAGCCACCGCCCAAGGACACACC |

TABLE 17-continued

Argonaute nucleotide sequences containing 2X Nuclear localization sequence (NLS) from Simian Vacuolating Virus 40

| SEQ ID NO | Sequence |
|---|---|
|  | AGACTGGCGCCTGGTGACACCGATTACGACAGGGGCGTACTTAGTCTGATCGGAGCCGCCCTGCTGAAAGCGGGTTACGTGCTTAC<br>TGAGCGCGAAAGGGCCGCAGTGCACCCCACGCAGCAGAGAGTGCCCCTGCACACCCCTAGGAAACTCCCTGCCGAAATTGCGGTGA<br>ATGCCCATCTTCGATGGGAATGGGAACTGGAACGGCACAGCGGGAAGTCTTGGCTTGTGCTTAGGCCCGGACGCATGTTTTTGAGT<br>GCGCTGAGCTGGCACGATTTGGACCTGAGGGCATGGGCACAGGAGTTGCCCCAGAGCGTACAGCAACTGCACGCGCTGTGTCTTCG<br>CTCCGGACGACGAGAACGACTGAGGCGCATGGGTAACACGTGGGCGTTCCAACGAGAGGATAGGGAGCAAGAGGGCAGGTGGCACC<br>TGAGCTTTAGCACTAAGGCGCTTTCCGACCTGAACCTGTCCGGCGATGCTCACCATGCTGCTAGCCTGAGCATGCCCGATGTGCAG<br>AGGCTCGTAAATCTGCCGGGTCTGTGGCAGCCCTTTGTGACAAGCCTTGAAGTCCTTGAGGTGCCTGGTAAGGTGATCGAGGGCAA<br>AAGGCTGAGGTTCGGACGAGGAACAGGGCGCGACGTCACGGATGTACACAAAAGGGGCATCCTTCACCCTCCGCCGCAGCCAGTGC<br>GCCTTGCGGTCGTGCCCCCCATTCAGGCGGACGAAGAGGCGGATGAGCAGTTGAGACGCGAGCTCCTTGCCCACCTCCTGCCACGG<br>GAAAAGGTGTTGGCCCACCCCGAGGCTTCCCAGGGCCTCAAGAAGCACTTGAATCGAAGGGAAACCGACGACACCTTCTACACCCT<br>GTGGAGCGCTGGAGACTACTGCAAACTGGGGCTGGAACCCTTTGATCTGGTGCGCGACCTCCATAGGTACGACCCCGGCACGGGTC<br>GCCTGCTGGCTCCAGAGAAGTTGCATGGAGCAGCAGCCGCCGCGAGAGAGGCTGGCAGGCAATTGATTGGCCTCGTGATCCTGCCC<br>GACACCATAGGGCGAGATGAGAGGGACGCACTGTCCGACGAACTGGCCAAGCTGGGTGTGAAGAAACTTCAGCACATCCGCAGGGA<br>CATGCTGAACCGGCCCAGGACGCAGTATATGGCCTGGGTGAACGTGGCCGTGAAGCTCGCCCAGAGGGCCGGAGCAGTCAGCTGGG<br>ACCTGGAAAAGTTGCCTGGAGTGTGCGAACAGACCTTCTTCGTTGGCGTGGATCTGGGCCATGACCATCGGGAGAAGCAAAGCGTC<br>CCGGCCTTCAGCCTGCACGAGTTCCGAGGCAGGCCGGTCGACTGCCTCACCCTTCCAAGGCGAGCCGGAAATGAAAGGTTGAGCCT<br>GGCGGAGCTGAATCAAGGCCTGAGGGAAGCTGCTTAAGGGTAAGAGGCCAGCCCAAGTGATAGTGCATAGGGACGGCAAGTACCTGG<br>AGGGGGAGGTTGATGACTTCATAATCGCTTTGAACGACCTCGGCGTGCCGCGCGTCAGTCTTCTCGCCGTCAAAAAGTCCAACCTC<br>TCCATGGTTGCCGGCGCTAAGGAGGGAGCGTTTTTGCCACTGGACGAGCGGCGGTGTCTGCTGGTTACCAATACCCAAGCCGCGGT<br>AGCTAGGCCGACAGAGCTGGAGGTGATGCACTCAGATCATCTGACTTTCGCCGAGCTGACCGAGCAAGTGTTCTGGCTGACCCGAG<br>TATTCATGAACAACGCACAGCATGCGGGTAGCGACCCTGCTACCGTAGAGTGGGCGAACGGGATCGCTAGGACCGGAAAGAGAATT<br>GCCCTGTCTGGGTGGTCCGCCTAGTAA |
| 142 | ATGCCCAAGAAAAAGCGAAAAGTAGAGGATCCAAAGAAGAAACGGAAGGTCGGCAGCGGAAGTGTGAACCATTACTATTTTTCCGA<br>ATGCAAGGCGGACGAGAAAGCCAGCGACATAGCCATCCACCTTTACACCGTGCCCCTGTCCAACCCCATGAGAAATACAGCTATG<br>CGCACAGCATCGCCTATGAATTGAGAAAACTCAACTCATACATAACCGTGGCCGCGCACGGTCAGTACATCGCGTCTTTCGAGGAG<br>ATATGCCACTGGGGCGACCACAGGTACATCAGCACGGACGAACATAGACCAATCCAGTGCAGCCTCCCGATGGAGAGGACCATACTGGA<br>AAGACTCCTCAAGAAAGAGCTCGAGAATAGGTGCAAAAGCAGCTATAAGATGGACAACGACCTTTTCCGGTTGGCTAACGAGCAAA<br>GCATGCACGTGGGCGAGATCAGCATACACCCAGCGATCTACATCTCATTCAGCGTGGAGGAAAATGGTGACATATTTGTTGGCTTC<br>GACTACCAGCACCGGTTCGAGTACCGCAAAACACTCCAAGACGTCATCAACAACGATCCCTCCCTGCTTAAGGAAGGCATGGAAGT<br>GGTGGACCCCTTCAATAGAAAGGGCCTACTATTACACTTTTGTGGGCATGGCCGATTATACCGCCGGACAGAAAAGCCCCTTCCTGC<br>AGCAGTCTGTGATCGACTATTATCTCGAAAAGAATGAGCTGTGGAAGCTCAAGGGTGTGCACGAAAAAACCCCCGTGGTGCACGTC<br>AAGAGCCGAGACGGTCACTTGCTCCCGTATCTGCCGCACCTGCTCAAATTGACATGTTCATACGAACAGCTCTTGCCCAGCATGAC<br>CAAGGAAGTCAATCGCCTGATTAAGCTGAGCCCCAACGAGAAGATGAGTAAGTTGTATACGGAGATGTTTCGATTGCTCCGGCAGC<br>AACAGGTGCTGACCTTCAAGAAGGAAAACGTGCGAGCCGTCAACCTCGGCTACGATGTGAATGAACTTGACAGCCCGATCATGGAG<br>TTCGGACAAGGCTACAAGACAAACGAGATCTATCGAGGCCTGAAGACAGAGCGGGATTATACGAGCCCAGCTCAGTGGCCGTGAGCTT<br>TTTTTGTTGACCCCGAGCTTAACTACGACCCCCAGAAGCGGAAAGAAGTAGGTTGCTTCGTCAAAAAACTGGAGAGCATGAGCGAGG<br>CCCTGGGAGTAAAACTGAACATAAGCGACCAGCCCCGACAACTTTATGGCCAGCTCCCCAAGGACTTTTTCAAGCAGGACAACCTC<br>TCATATCATTTGAAATCTATCACCGACCAGTTCAGGGGAACGGTGGTGGTTGTTATCGGCACTGAAGAGAACATCGACCGGGCATA<br>CGTTACAATCAAAAAGGAATTCGGCGGCAAGGAGGATCTGATGACCCAGTTTGTCGGCTTCACCTCCTCCCTCGTCACGGAGAACA<br>ACATTTTTCACTACTACAACATCCTGCTCGGCATCTATGCGAAAGCTGGTGTTCAGCCCTGGATACTCGCCAGCCCAATGCACTCA<br>GACTGTTTCATTGGACTCGACGTAAGCCACGAGCACGGTAAGCACGCATCAGGGATAATACAAGTGATTGGACGGGACGGCAAGAT<br>TATCAAACAAAAGAGCGTTGCGACAGCAGAGGCCGGAGAGACTATTGCCAATAGCACGATGGAAGAAATCGTCAACGAAAGCATTT<br>ATTCCTACGAGCAGATCTACGGGGCCAAACCGCGCCACATAACATTCCATAGAGACGGGATCTGTCGCGAGGACCTCGATTTTCTG<br>CAAGCGTATTTGCGGAGTTTCCAAATCCCATTCGACTTCGTAGAAATCATAAAGAAGCCGCGACGCAGAATGGCGATATACTCTAA<br>TAAGAAGTGGGTCACGAAACAGGGAATATACTACGTAAGGGCAACACCGCTTATCTGTGTGCCACGGACCCCAGAGAATCCGTGG<br>GTATGGCGCAACTTGTCAAGATCGTACAGAAGACTAACGGATTGAGCGTTCACGAGATAGTGAGCGACGTGTATAAGCTGTCCTTC<br>ATGCACATACACAGTATGCTCAAGACCAGGTTGCCTATCACGATACACTATAGCGACCTCAGCTCAACGTTCCACAACCGGGGCTT<br>GATCCATCCCCGGTCCAACATGAGAGAGCACTCCCGTTCGTGTAGTAA |
| 143 | ATGCCTAAGAAAAAGCGGAAAGTTGAAGACCCCAAAAAGAAACGAAAAGTCGGAAGCGGCTCACTGGGGCTGAATAATGAGTCCAA<br>AGAGTTCTTTAAGGGCATTAGCCGCATTTGGAGAAATTACAAGGACTACACCTACCTTGACGGGATTAAGCTGAGCCAGGCGCAGA<br>TCGTATATCATCGAGAAGGAGGAAGACCAATTGCTTATAGAGGGCTACGCCGGCACCGGTAAGTCCCTGACCCTTATATACAAGTTC<br>ATTAACGTGCTGGTTCGGGAAGATGGGAAGAGGGTGCTGTATGTGACTTTTAACGATACGCTGATCGAGGATACGAAAAAACGCCT<br>TAGTTATTGCAACGAGTACAACGAGAATAAAGAGAGGCACCACGTAGAGATTTGCACATTCCATGAGATCGCCAGTAATATCCTGA<br>AAAAAAAGAAGATCATAGACAGGGGTATTGAGAAACTGACAGGCTAAAAAGATAGAAGATTACAAAGGTCCGCTCTCCGCAGAATT<br>GCGGGAATCCTGGCTAGGTACATCGAGGGGGGAAAGTATTATAGCGAGTTGCCTAAAGAGGAACGCCTCTACAAGACACATGACGA<br>GAACTTTATCAGGGAGGAGGTGGCCTGGATCAAGGCCATGGGCTTTATAGAAAAGGGAGAAGTATTTCGAGAAAGATCGCATTGGGA<br>GGTCAAGAGTATCAGGCTGACGCGCTCACAACGCAAAACTATATTCAAGATATTTGAAAAGTACTGCGAAGAGCAAGAAAACAAA<br>TTCTTCAAAAGCCTCGACTTGGAGGATTACGCCCTGAAGCTCATCCAGAACATAGATAATTTCGATGACCTTAAGTTCGACTACAT<br>TTTTGTGGACGAGGTACAGGATCTCGATCCCATGCAAATTAAGGCGCTGTGTCTGCTGACCAATACGAGCATCGTGCTGTCAGGCG<br>ACGCGAATCAGCGGATTTACAAGAAATCTCCCGTGAAGTACGAGGAGCTCGGCCTCAGAATCAAAGAAGGGAAACGGAAAATT<br>CTGAACAAGAACTATCGGTCCACGGGTGAGATTGTCAAGCTCGCGAACTCAATCAAGTTCTTCGACGAGTCCATCAATAAGTATAA<br>TGAAAAGCAGTTCGTAAAATCCGGTGATCGCCCGATCATCCGGAAGGTGAACGACAAAAAGGGTGCGGTGAAGTTCCTGATCGGCG<br>AGATCAAAAAAATCCACGAAGAGGACCCCTACAAAACAATCGCCATCATCCACCGAGAGAAAACGAGCTTATCGGCTTCCAAAAG<br>TCCGAGTTCCGAAAGTACCTGGAAGGCCAGCTGTACATGGAAAAATTCAGTGACATCAAGTCCTTTGGTCAAAGTTTGATTTGAG<br>GGAAAAGAACCAGGTGTTCTACACCAACGGCTACGATGTAAAGGGGCTGGAATTTGATGTGGTGTTCATCATAAACTTCAACACGG<br>CCAACTACCCACTGAGTAAAGAGCTGAAGAAAATCAAGGACGAAAACGACGCAAGGAAATGACGCTCATTAAAGACGATGTGCTC<br>GAGTTTATCAATCGCGAGAAGAGGCTGCTGTACGTAGCTATGACCAGGGCCAAAGAAAGCTGTATCTCGTGGCCGACTGCAAAAA<br>CAGCAACATCAGCAGCTTCATCTACGACTTTAACACCAAGTACTATGAGGCACAAAATTTCAAGAAGAAAGAGATAGAGGAGAACT<br>ACAACCGGTACAAGATTAACATGGAGCGCGAATACGGCATCATCATTGAGGACGACGACTCCAACAACGTTAAGAACAATGACACG<br>AAACAAGAGAACAAGTTTAATACCGAATCTAAGGAAAAGGGCAAAGATGACATCGACAAGATAAAGGTGTTTTTCATCAACAAGGG |

TABLE 17-continued

Argonaute nucleotide sequences containing 2X Nuclear localization sequence (NLS) from Simian Vacuolating Virus 40

| SEQ ID NO | Sequence |
|---|---|
|  | AATCGAGGTGGTGGACAACCGAGATAAGAGCGGGTGCTTGTGGATCGTCGCCGGGAAGGAAGCGATCCCTCTTATGAAGAAGTTCG GTGTCCTGGGCTATAACTTCATATTCATCGCAAACGGCGGTCGGGCATCTAAGAACCGGCCAGCCTGGTACCTCAAGAATAGCTAG TAA |
| 144 | ATGCCAAAAAAGAAGAGAAAGGTAGAGGATCCCAAGAAGAAACGCAAGGTGGGGTCCGGCAGTATGGACCGCGAGATCATTGAAAA CTTCAACCCCAGCGACCCCAGGACCGAGGGCGAGAAGTATCTGATGGATAACTTTTCAACCTCCCCCAGGTTTAATGGCTGGACAA TATTTGAGCAGCCCCACATCAACTCAATGAAGCCCGACTTCATCTTGCTGCACCCCCACAAGGGCATCATAATCATAGAAGTGAAG GACTGGAACCTCAGCAGCGAGACATATGAGAACGGCGGTTACATCTGGGGGGAAAACGGCGAGAGGATTAAGAAAAACCCCATCAA TCAAGTAGAAAACTACAAAAACTCTATACTCAAGATGGAACTTACAAACAGCATCGAATTTAGTGAAGTGTTCGGCGACAAATACT TCGCGTGCATAGAAACGGTGGTATACTTTCACAAAGCCAACAAAATTCAAGCCGAGAACTTCTGCAGGAGGAACAATAACTACACC AAGATCTGGACCAAGGACGAGTTCGACTACATATGCAATATCAAAACTGAAGGGCAGTTGTCACACCTATGCCCTGAGCTA CGAAAAAAGCACCCTTGAAGACAACAGAGGTATGCTGAGTAAACTGGTGGAGGAGCTCAAGTGCAATCTCCAGTACAGTGACTACA ACTATGAACGACGCCAACCGATTAAGTTGACCTATGAGCAAGAGAAGTTGGCGAGGCTGCAAAAGAATTCAATCAGGAGGTGGAGC GGCGTGGCAGGCGCTGGCAAGTCCCTGAGTCTGGCGCAAAAAGCCGTGAACGCCCTGAAGGAGGACCATAGCGTTCTGATCCTGAC CTACAACATAACCTGAGGCACTACCTGCGCGATCTGTCCTCAACAGTTCGGACCCGGCTCCTACAAAGGCGAGCGCAAGAAGC TGAGGAGCGACCTGACCATCTGTCACTTTCATGACTTTTTGAGAATCATCATGGCCGAGTACGAGATCGAGGTCGAACATGACGA GACGACAACTTCACCCAGCACTGGATAAACAAGATCGACAGTTGCATAAAGGTGAACGGCATCAAGAGCCACCTCAAGTACGACTA TATCCTGATCGACGAGGGCCAAGACTTTGAAGGCAATGGATTAGGTTCCTGAAGCAGTTCTTCACCGAGGTGGGTGAGATCTTTA TCGTGTACGACAAGGCCCAGGATCTCTACGAGCATGGCGTGTGGATCGAAGACAGCAACCAAATCAAAAACATCGGCTTTAAGGGC AAGCCCGGGAACCTGAAAATCAGTATGAGGATGCCTGAGAAGATGGTGTACCTGGTGCAGGACATCAGAAATGAGTTCAAGATAGA TGAGGAGGAGATCACCCCAAACGTGAACAGCCAGCAGAGCTTCATCGAGATAACCAAGTGGATTAACTGTATGCCCCTGACGCTCA CTGAAAAGCTCGACCAGATTGAAATACAGGTGGACTTTCTGCGCCGAAACAACAACAGCCTGGAGGATATCACGATCATTACGACC AACGAGGAGACCGGAGTGGAGATAGTGAATAGGTTCAAAAGCAGGGGTATCAAGACCAGCCACGTCTACGATATGGAGAAGCGGGG GAACCAGGCCAGGCGAAGGATGGAAAAATGGAAATTCCAGGGCGGCACCGGCAGACTGAAGATTTGTAGCTATCACAGCTATAAGG GCTGGGAGACTCCGAACATCATCCTTGTGCTGGACGAGCCGAGCACAAAGTATGAAGACGGCATAATTAGTAAGGGGAGTATAAC GAGAAGAACATTTTCGACGCTATCTTCATTAGCATGTCCAGGGTGAAAAGGAAAGCCCAAACCGGTGAGTTTAGCTTTACGTGCCT GAATTATCTTAGCGAATACAATAAGATTGAGGGCCTCTTCCACTAGTAA |
| 145 | ATGCCCAAGAAAAAGAGGAAGGTTGAGGACCCCAAAAAGAAGCGCAAAGTAGGTAGCGGCTCCATGCTGACCAATAATCAGATTGT GCTGGAGCAGGAACTTCTGGGAAGCATATTCAAAAACAATAACCTGATGCTGAAAGCCCGAGAGAAGATAAAACCGGAGATGTTCC TGTATAGCACAAACACATGAACATTTACCTGGGCATCCTCGACATGGTGGCCAACAAGCTGGAGGTGGACCTGATCACCTTTCTCGAG CACCATAAGAAAAGGGTGGGGGATATGGATGGCGTAACTTACGTGACCGAGATCTACACCTGCAGCGCGTCCGACATTGGCTTCAA TACAAAACTTGACATGCTGGTGAACAACTACAAACGGCATCTGTATGTGGAGATGAAGGACAAAATCAACAGTGATATGAGTCTTG AGGAGATCGAGAGCGAGGTTGAAGGGGTGAAGGTAAAGGTGCACAAATGCAACATCAAGAAAGAACTGGATATAGACAAGCAATAT GACGATTACATCAACTGGCTTTACGACGAAAACAGAGACAAGGGGATGAAAAGCGGCCTGACCTATCTGGACAAGTATCTCGGCAA CTTCCAGAAGGGCAGGCTCGTCACCGTGTTCGCCAGGAGCGGCGTCGGCAAGACCACGTTCAGCTTGCAGCTGGCCGCCAATATGG CTCTGAAGGGCCACAAGATATTCTACGGGAGCGCAGAGATGACCCGCAACCAGGTCTTTAACAGGATCGTGGCCTCAGGTTTGAGC CTTAGCGCGAAGGCGATTGATGAGGACACCATCCTGAAGGAGGACAAGGAGAGCATCGCCAAGTTTATGACCAAGGTTATCAACAA CAAGTTCTACGTGTCAACCGAGACCGACTTCGAAAAGTTCATCGACGAGATAAAGGTTTATAAGCTGCAGACAGTCTGGACGTGG TGTTCGTGGACTACATTAACAAGTACATCGACTTCACCGACAGGGACATGTTGACCAACAACATCAGCGGCATGCTC AAGAGCCTGGCCATGGAAGAGGGATATCTGCGTGGTGCTGATGGCCCAGGCCAATAGAGTGATTGACAAGAAGGTGGGTGACAATGC CGTCGAAAAAATCGACAGCAGCGACATCCAGGACAGCGCCAGAATCGAGCAAGACAGCGACCAAGTGATCGGCCTGTACCGGAACG TGAAGCTCGATGATAAAATGTATAGGGAGAACCTGTTCAATCAGGGCAAGCTCAAGTATAATTCCAAGAACGCCGACGACAATCCG GAATCATGAACGCTGTGATCATTAAGAACAGGCATGGCGACCGAGGCACGTGTGCACTGAGGTGGCACGGCAGGTACAGCAGGGT CAGCGACTTCTAGTAA |
| 146 | ATGCCCAAGAAAAAGCGGAAAGTCGAGGATCCAAAGAAGAAGCGCAAGGTGGGTTCCGGGAGCAAAGGGCGGCACCAGGCGAAACA CTACGCGGACGGCCTGGAAAAAATGCACGGGCAAAGGCCTGTGATTTTCTACACCAACGGCCACGATATATGGATATGGGATGACC ATCCGGCTCAGCACTACCCGCCCAGACGGTTGTACGGATTCTACGCGAAGTCCAGCCTGCAGTATTTGATAAGGCAGCGCAGTGAA CGCAAGGCGCTGAATACGGTGAGCTCTAAAACCGATATACTCGGAGAAAGACTCTACCAGCACGAGGCACTGAAGCGGATCTGCGA ACGCTTCGAGACCAAGCAGAGGAAGGCACTCGCAGTCCAAGCGACCGGCACGGGGAAAACCCGCTTGTCCATCGCACTTACTGACT CTTGCATGAAGGCCGGGTGGGTGAAAAGGGTGCTTTTCCTGTGCGACCGAAAGGGAACTTAGAAAACAAGCTAAGAACGCCTTTAGC GAATTCCTCAGCGCGCCTATTAGCGTACTGACAACGAAAAGTGCGCAGGATACCCACAATAGAATCTTCGTGGCAACCTACCCCGC GATGATGAAGGTGTACGAGCAACTGGATACGGGATTCTTCGACCTGATCATAGCCGACGAGAGTCACCGAAGTATTTACAACATCT ACGGCGACCTCTTTCGCTATTTTGACGCCCTTCAAGTGGGCCTGACCGCAACCCCCGTGGAGATGGTATCTCGGAGCACCTGCCAG CTCTTCGGGTGTGACTTTAAGCAACCAACTTCTAATTACACACTCGAAACGGCTGTGGAGGAGGGTTATTGGTGCCCTACCAAGT CGTGAAACATACCACAAAGTTTCTGCGCGATGGGATCAAGGGCCACGCGCTTAGCGCGGAGGAACTGGCGGAGCTGGAGGACAAGG GCATCGATCCTAACACTCTTGATTTCGACGCCGAGCAGATCGACCGAGCGATCTACAATAAAGACACCAATCGGAAAATCCTCAG AACCTCATGGAGAACGGTATCCGGCAGGCCGATGGCCAGACCCTCGGTAAGACGCTGGTATTTGCTAGGAACCACAAGCACGCCAA ACTCCTCGAACAGTTGTTCGACGAGCTGTACCCCCAGTACGGCGGTAAGTTCTGTCAGGTTATAGACAACTACGACCCCAGGGCGG AAGAGTTGATAGCGATTTTAAGGGCGAGGGCAGCAACAGCTCACTATAGCAATCTCAGTCGACATGCTCGACACCGGATT GACGTCCCGGAGATCGTAAACCTCGTATTCGCACGGCCGGTTAAAAGCCCCGTGAAATTTTGGCAAATGGTTGGTCGGGGAACGCG ACTCTGTAAGATTTGTTTGGACCCGGCAAGCACAAGACGCACTTCCTTATTTTCGACCACTGGGGAGTCGTGGAGTATCACGGCA TGAAACAACGCGAGGTAACTGTGTCCCAGAGCAAGTCCCTGATGCAGCAATTGTTTGAAAATAGATTGGAGCTCGCCAAGACCGCG TTGCACCCACGCCGAAGCCGACTTTTTTGAGACGATGGCGGGTTGGCTGCACAAACGATAAATAGCCTGGACGATCGAACGATTGC CGTTTGTGATAAGTGGAAAACTAAGCAGCAAATGTCCGACCTGGAGACGCTTAGACAGTTCGGTGCAAACACCGTCACGCTGCTTG AGTCAGAAATCGCCCCGTTGATGCAATGGCTGGATGTCAGAGGGCATAGTGACGCATATCAGTGGGACCTCCTGGTCTCACAGATC CAACAACAAAAATTGAAGCAGGCGGCAGCCTTCGATGATCTCGCTGGGAGGGCAATCAATCAACTGTGGCAGTTGCAGATGAATTT GAATCAAGTTAAGGCAAAGTTCCAGTGGATTAAGCAGTGCCAGGAACTGCGGAGTGGTGCCAGAGGCGTCCCTGGATGAACTGGAAC AAATGCGACAAGAACTGCGGGCATTATGCAGTACAGGAACAAGGGTGACATTCCGAAGACAGAGGCGCCCATCATAGACATAACG GACTCAGAGGAGGTGCGCGAGAACAATCCTCCTACCTGAACTCAGTTGACATGGTCGCGTATCGGGTCAAGGTTGAACAGGCGCT CCAGGAGCTCTTTGAGAGAAACCCCATCCTTCAGAAGATCCGGAACGGGGAGGCCGTGTCTGAGCGCGAGCTTGAGAACTTGAACG CTCTCGTGCATACACAACACCCGGATATCGATCTCAACACACTTAAAAAGTTCTATGGGACCGCGGCTCCGATGGATCAAATCCTT CGGACAATAGTAGGCATGGACGGGAACACGGTTAATCAGCGCTTTGCGGCGTTCATACAACAGTACCCCTCACTGAGTGCGCGCCA |

TABLE 17-continued

Argonaute nucleotide sequences containing 2X Nuclear localization sequence (NLS) from Simian Vacuolating Virus 40

| SEQ ID NO | Sequence |
|---|---|
|  | AGTTCAATTCCTGTCCCTGCTGAAACGACAAATTGCTCAGAGTGGGGCCATAGAGATTGACAACTTGTACGAAATGCCATTCGCAG<br>CTATCGGCGAACCCGACAGCGTATTTAGTAACGCGGAACAGATTGATGACCTTCTGGCGATTGTGGAGAGCTTCGGGAAGCAGCCC<br>CAGCAGCAGTCTACGAGACAGGCCAATGAGACATAGTAA |
| 147 | ATGCCGAAAAAGAAACGGAAGGTAGAGGACCCCAAGAAAAAGCGGAAAGTTGGGAGTGGAAGCATGCCGTTCAATAGCAACCTGAT<br>CTTCGTGAAGCTCGACGACCTCAAGAGAGCCTTTCTCGAGGGCGTCCACAGTGGTCACGCCGTGGTGTATGAGGTGAGCGAGGGAC<br>TGAGCACCGAGGATCTGAAGAAAAGGCTTATCAAGGCCAGCGTGATGTACCACTATAGGTATGGAAGGAACGTGTTTGTCTTCGGC<br>GTCAAGGAGGGCACTAAGGTTGACGATCTTGTACCAGGCCGACGACTCGGCGAGCACGAGGTGAAGGAGGTTCTCAAGGGCATCCC<br>GTCTAACAACCTGGTGTCCATGATGAGCGCCATGCTCAATTACCAGCTCTCTGTGCTTCTCACCAGCAAGGGCTTCCAGTATAGCT<br>ACGAAGAGATGCGGAGGGGCAAGTATCTGTGTGTCAGCAACTATTACGGCAAGCTGATACGGAACCCCGTGAAGGTTTGCCTCAAG<br>GTAAATGTCATAAGGAGCCTCATTGACGAGCAGGATCAGTACCTGCCCATCGCGCTTAACTACAGGGTGAAGAAGAGCAGGCGGCT<br>TAGCCCCGAAGTAATGAATGAGATCCACGCGGAGTTCATGGAGGCCTTCCCCAGCTACCTCAACGACCTGAAAATCATAACTCGCG<br>TCTTGAACGACGATATGGTGAGGAACAGGGAACTGAAATTCCTGGAGATCGAGTACAAACCCCCTGCTATCATTACGTTCCGGTTT<br>CGAGGCAACAGCACCGGCGAAAACGTGACCGACATTCTGAAGCTGGGCCCCTACTTCCTGCCTGGGGAGGAGGAGAAGATCGATGT<br>GGTCTTTGTGTACGAAAATGCTCTCGCTAGCCAGGCGAAGAAACTCACCAAGGTTTTGGAGGATACCATCAAGGACGGGCTGGGCA<br>TAAAGCTGAACATAGACGACGAACATAAGTTCAGCCACGACAAGCCGCTGGGCGACGTTATTAAGCTGGTGCGCGACCGATTCATC<br>AACAGCGGGAGTTGTCTGCTGGTCCTTAGCAAGGAGAACCGCCTCGGTCCTATCTTCATGAGCATTAAACCGCTCACGCTCAAGAA<br>GAACTTCTACTTCAAGTCTCAATTTATCACCAACGAAACGATTAGCAAACTGGACTCTTATGCGGTCAAAGCCAATATCGTGAATA<br>GCATCCTGTTCAGGGTTGAAGGTACCCCGTACATGCCCGTTCTGCGGGGCAATATAGACGTACTGGCAAACAATTTGTTCGTGGGC<br>ATCGCCCTGAGTAAGCCTCTGAGGAAGGGCTACACCAAAGGAGGCATAGCCCTCATAGACCCCTACAGCGCCCGAATTATCACAAG<br>GGCCATCGTGTTGAAGCGCAAGATGAGGAGCGGCAAATTCGAAGCCTCAGACATGCACGAGATCGTGTCCAACATCAAAGGCGTGC<br>TGAAGGACTACAAGGAGCTGTACAACGTCAACGAACTTGTTATACATATCTCCAAGTTTCTGAGCGATGACGAATACGGCCTTTTT<br>TACGAGTACTTGCAGGACCTTAATGTCAACGTGCGACTCCTGAGCATCAGGAAGAGGGACGACATTACACTGGTTAGGGACGGGAG<br>GATGGACAGCCTGACCATGATCAAGCGCGGCAAGAGTCATGTCGAGGTCATGTATTGGCCTCACGAAAGGGCCTACCACCCCCTTA<br>CTATCAGGATCTACGGCGACAATGTGGACAGGGACGTGATGATGCGACACCTGAGGTTTATCGAGCTGCTCCGGCACATGTACTAC<br>CCGGCCAGCAGCCGCTTCATAGTTGAGCCCGCGACCATTAGCTACAGCAGGAGGGTCGCCAGATTTGCCCCCTGGCTTTCAGACAA<br>TACCTAGTAA |
| 148 | ATGCCCAAGAAAAAACGCAAGGTGGAGGACCCAAAGAAGAAGAGGAAGGTCGGAAGCGGCAGCATGGAGAAACAGACCTTCTACCA<br>GGGCAACATGTACAGGCTGAAGGATGAATTGATACAAGATATCCTCTCTGACATTATCGTGGCGAGAGTAACTAACATGCCAAGCA<br>ATCCCGAAGAAGCCTACAGTGAAATACAGAAGATTGGCGGCATTATACTCAATTACGATGAGATGACCAACAGCGCCTGGGTGGTG<br>GGCAAGGAGTCTCTGCTGCAAAATCACTATCCCGACGACATGGAGGAGGTGCGAGCCTTCTCCTTTTCTGAGCTGTCCAAGGAAAA<br>CAAGACGAAACTGGTCCTTAATATCCTTAACGCCGAGGGCTACCTGCGCGACATTAGGGGGCACCGAGAAGTGGTGAAGTCAATCA<br>ACTCAGAGCGATCAATCATTAGAAAATTCTTGGTGACGGTCGAGTACGATGGTCAACACTTCTATCTCGTAACCCTCCCAAAGTAT<br>AAGATCATAGAGAATCACACAATAATGGAACTCCTCATTGAGGGCAAGATCACCGTCAAAGAGCTCGTCCACAACCTCCTCAAGGA<br>CCCTAAGTGGAAAATCCAGACCAGTCGCAAAGATGTGCCCCTGCCTCCTGGGCACAGGGTCGTGGAGATCATTCTGAAGACTAAAG<br>ATCCCGATCGATACCAGCAGGAACTCGAACGCATCAACGAGTATTTTACTAAGAAGACGGAACTGGGGCCCATTGACGATAGCAAG<br>TATCCAGATGATTATAACATCATTTTCAGAAGCCAGACGCGAGGCAAATACTTGAGCTATCACAGTGCGCGGACCAAGCTCATCAG<br>ACCGATTAACAAAGAAATCCTCCGAGAAATCTACAGGAGTAACGAATTTATCAAAGCACTGAACATCGCCAAAAAGCTGGTGGCCG<br>ACATCATATACGACAGCACCAAATACCCGGGCAGGGCCATATTCCCCGCCTTTAAGATAGACGAAGCGGACGATCTCATACAAGGCC<br>GTGTTCCTGAAGATAAGACGATAACCTGAGAAAACCATCCAACCCTACTACAATATCAAGGGTACCTTTAATTGGCTTTTCACCAA<br>CACGCCGTTCGACGATATTAGCGAGCTGATAATACCAATCCAGTCCCCCGAGTTCTTGAGGGATAAGACCATTGGAGTGTACATCC<br>TGTACCCTGCGAAGTACAGAGAGAACTCCGAAAAGCCTGAAAGTGATCCAGAATCTTATCAAGAGCGTAGATAGCACGATCAAACGG<br>CTGAGCGAGTACTTTACATTCCTTCGAAAAGTCAACGAAGGCCTGTCTCTCCCCTCTGCTATAGATATCATCTCTCGGATCCCGGT<br>TAACTATGAAAACTTGATAGAGAGTGCGTTTACCCGGATCCACAGCAAGAAGGGCGTTGAATATGACTACCACCTCGCGATAACAC<br>TGATACCTGACATGCGGCAGGAGCAGTTCGATAAAATCAAAGGGTTCTTTTTCAATAACGGGATTCTGCACAAGGCAATAAACATC<br>AATAATCTGAGGGACCCCAGCAAAGACCAAAAGAAGCTGATTGAGAGCATGATCCTCCAGGCACTGTACGCCTTTGGCATCTACTT<br>CTACAGCCTTGACAACCTGAACTGAACTGACTTTATCATAGGTCTCGACGTGACCAGGGAAGCAAGTCTGGTAGGTACTACGGTA<br>TATCCGGAGCCGCGGTGGTCCAAAATAAGAACGGCCAGGTATTGAAGATTATACCGATCACCAGCCCCCAGAGCAGCAGCGAAACC<br>GCAAACATTAACTACCTCATCGGCAATATCCAACAGGAAGCCGCTGCAATCCTGAATCGGAAGGGATACGCGGACATATTGTTCCT<br>CAGGGACGGCAAAGTGCCCGGTGGCGAACTGGAACAGTTTAAAGAGATCAGCCGCAAGTACAACTACAGGTTTACTATAATAGAGA<br>TCCTCAAACGACCCCTTGTCCGCTTTTTCTGGGAGAATTACAAGGAGCACACCGTGAAGAGCCCTAGGCATAACTACTACTTCAAG<br>ATAGGCGACACGTATTACTTGACCGCGCATTACTTCACGAATTACCTGAAGGTCCCACTCAAATTGGGTAATACCTATTTCGTGGC<br>CCGAGGAAAGATAAGTAAAAACGTGATTAGCCGCGAGGACATAATGACAATCACAAAGCTCACTAAGCTCAACTATAGCCAGCCCG<br>AGAACCCGGACAAAATGAAGCTGCCTGCCCCCGTGCACCTGAGCCACCGACTGATCAATTATGAGAGGAGAGAGCTTAAGTTCAAC<br>AGGTATGAGTTTCTTAAGGAAGGAGCGCTTTATTTCCTGTAGTAA |
| 149 | ATGCCTAAGAAGAAACGGAAGGTGGAAGATCCAAAAAAGAAGCGAAAGGTTGGTAGCGGCTCAATGGCCTATAGCCTTAACGCTTT<br>CGAACTGGAAATTCCCGACATTGACGCCGACCTCTACAAAGTTGACCCTCAACCCTCTGATGACCCATATCGAATCCTGGGGGTT<br>TGGAACGGTCCTTCGAGCAACAACTGGACGGCAAGGCCCAGAAATGGAAACAGGCGGAGGACGGAGATTGGTATATCGCCGTGATA<br>GGCGCGTCAGAAAGGAAAACTATCGAGTCCCCCTCCAGCGGTACGAGGGCAGGCTACACCACCACGCATACGCTGGATCCGAGTAG<br>CTTTTGGGACAGGATGGTGTTGCAAAGGGCAATTAGCGACTCTGTACGATGGTACATGACCAACTATCAGGACTTTTGGTATCATG<br>AGGATGCGGATGCACTCTTTTATCCTTCTCCTAGAGGCAAAGTTGGACGAGTACGACGTCTACACCGGATTAGTCATAGGGTCGAG<br>TTTTATGACAGCCCACAACTTGTCGTGCGCAGCGTCACTAAGTTCATCTCCAGTGAAAGCCTGGCGGACCGGATCAACCATCAGGG<br>CACAGAAGAACGAACGGAAAAATACGGTGGTGAG+ACTTTAGGCTGGACAGGCCGGAACCAACCAAATGTACTTTGCACGGCATCT<br>CAACCGAGCGAACGGTAAGTGACAAGACGATAGATTTTGGTGACGAGATGCTGTCCGTGTTGGAGTTTGCACAAAGAAAATATGGC<br>AGCGAGTGGGCGGACAAAATCGATCCCGACGAACCATTGGTGCAGATACGCTTCGGGAACAGCGACCCCTACGACACCGCTCCGAG<br>CCTGCTGAATGCGAGCCCTGAGGAGCTGAATCGCAGGCTGACCAGCGAGGCAGCCCTCAGCGCACAAGAAAGGCAGAAGGCCATAC<br>AGAACTTCATCGGCAGGATCACTACATCCAGGTTGAAGACGAGAAGGTGAGCGTCAGCGATGACGCGTACGACCCTACCGACGAG<br>GGCGACTTCGACTACCCCGATCTTGCGTTTGGCAATGACGAGGTGCTCAGCACCGGCGTCCCGAACGCGTAGATCCTAGCCAGGA<br>GGTGCACCCGGGCAACTGGCGATGATAATCAGGGACTACCTGGAGGAATACGGCTTCTGGGAGTCACAACGAAACCTGTCTGAGA<br>TCGTGCTGGTGTACCCGAGAGGCGAAGAAAGACGGGCAGAGAACCTGTACCAGGACGTTAGGGAGAAGCTTTCAGAGATAGGAGGC<br>GTTCAGATCAGGAGCGATCCACATCGCGTGTGTTACACCGATCAGGTGGAGTTCGACGAATGGGTGGCTGAATTCGGTGACTCAAT<br>CGACGGTGTTCTTGGATTGATTGAGGGAGATGGAGACGAATACTACGAAATCATAGATGCATTTGGCGGAGCACCGACCCAGTACG |

TABLE 17-continued

Argonaute nucleotide sequences containing 2X Nuclear localization sequence (NLS) from Simian Vacuolating Virus 40

| SEQ ID NO | Sequence |
|---|---|
| | TCAACACTAGCACCTACTCAGAGCACAGAGGGGCGAGCGACGACGTGATCTTTAACACTGCTTGCGGACTGGCCGTGAAGTTGGGC<br>GCATATCCTTTTGGCCTGGCCAACGACCTGAACAGTGACGTGTACCTCGGCCTTAGCGTGGCAGGGGATAGAAGCACAACGGCCAC<br>CGCCGTTGCCATAGACGGAAGAGATGGGAGGATTCTCTATCAAACAGAGGAACCCCTGGGCCAGGGTAGCAGCACAGTAAGCGAGG<br>GCTATCCCGCTAAGCGAATCATCCAGAGGAGCCTGAAGACCGCCTCAAGCGCCTTTGATCGACCAATCGAGAGCTTCGACATTCAC<br>AGGAACGGAGACTTTGGCGACGCTGAGCTGGAAACCCTTAGCAGTGAATTGCCTGCACTCCAGGACCAGGAATATGTGCATACCGA<br>TGTTTCATGGAGCGCCGTCGAGGTAATTGAAAACCACCCTTACAGGCTCTTTAGTGAACGGGGCAGCAGAGCTCCCGATACCGGAG<br>CCTATGCTAAGCTGGACGACGAGCATGTACTGGTTACTACCTTTGGAGAGCCCCAGATCCACCAAGGTACGCCAAAACCGGTCCTG<br>TGCAAGAGGAGAGCAACGAGCCAAGATCAAGACATCACCGCCATCGGAGAGGACGTGTTCAAACTCAGCTTCCTTAACTGGGGTAG<br>CCCAATGATGAAGATGAAGCCACCTGTTACCACTAAGATTCCGAAGGAACTCAACGAGATTTTCGAGAAGTGCTCTAGGGTGAGAT<br>ACCCCCCCTTCTAGTAA |
| 150 | ATGCCTAAGAAAAAAGAAAGGTAGAGGACCCGAAGAAGAAGCGCAAGGTCGGCTCCGGAAGCATGAGTCAAGACTCTAGGAGCAC<br>CGAGGTGGAGAGGCAGGCCGAAATACAACCTGGTACCTACCTGTTGAACGGCCGGGGGGAAATTCAGTTGGATGAGGTTGACGCAT<br>TCCAGTACGACCTCAAGGTGAGTGGAGGCGTGGAGCAGTATTGGGATCGGGAACAATTCACCAGCTCTGCAGCCTACTACCTGGAC<br>CAGGAACACGGGAGCCCTGTCGCTGAGATAGGCAAAATGAACTGCTACCCAAGGCGGATTTGTCTAGATCAGTTAGAGTGTGGCA<br>GAGAAACGTGACTCCCATCAATAGGCAGAGCGTTACACTGACCGCAGCCCAACCCGAGGACCGAGAAAAGATCAAATCATTCGTGC<br>AAAGCTGCTTCAAGAGGGCAGTGCCGACCGAAAAATACAGCTTTCGCTTTCTCAACAAGATTGTCAGGGATGAGCCCGAGTTCACC<br>ACCGGCAGCGAAGGCTTTTCTGCACATCCGAAGCACGACGTTAAGATACAGGTCACCGCTGATGGCAATGTGCTTGTGCACGTGGA<br>TAGCGGGTTCAGCATCAGGAGCAACAGCACCCTGGACGAAATCTACTCTGAACAGGATAACCCTTACGGTAAGCGCGTTGCCCACG<br>ACCCCGAGAGGTATGGTACCCAGGGCCAAGGCACCCTTCGCGGTTGGAGCGACTATCGGTACACAGACCATATTAGCGATGCGGGT<br>AGCTCTGTGAACGAAATGCACAAAGGGGTGGCGGACGAAGAATGGCGGCAACGACTCGCAGAGGAGAATCCCCGACTTCTGAAAGT<br>GGAGTATGGCAACAAAACTAGGAGGCAAGCCCCCCATTTCCTGAGGCTCTCACCGCGGATCGAGCAGGTGCAGGATCAGGATCGCG<br>AGTTCTATAGCAGGTTTAACAGCCGGAGCGCGATGATGCCCGACGAAAGATTTGAACTGTCTAAAGAGTTCCTGCAGAACGTGAGC<br>CGCTTGCCGGTATTGGACATGGAACTCGAGCCGGGTCCGGTGAACAGCAGTTACGAGTTGCTGGAAATGCGAGAGGAAAACAGGCT<br>GGTTTTTGGAGGGAAGCAGAGGGCTAGAGACCCGGGCAGCGGGCTTAGAGAGAATGGGGTGTATCAAAGTCCCAGTCAGTACCGGC<br>TGGGGGTGTTGACCCCGAACGATGGGGAGAGAAGGCGAGCGAGCTGATCCCCCTGATTGTGTCCGGCCTGAACGATCTGAGCGCA<br>TCAGCAGGAGTTCGAGCATATGGATACGAATTGGGGGACGTCAGCAATTACACACCCGTGGTTCAGGACCTCCACGAGGAGACGGA<br>CGCTGTGCTCGCCGTGGTCCCCAATAAGGGTGTGGCCGAGGATTTTGGGATAGACGATCCATACAAGGAGCTGAAAAGAACCCTCC<br>TGCGGAAAGGGATACCCACCCAAATGATGCAAAAGTCCACGGTCGATGAAATCGTGGGTCAAAAGGCGGGAATCGGCAATGACAAG<br>TTTCTGAACGCACTTAGTGCAGTCGTGGCCAAAGTGGGCGGTACCCCATGGCAGATCGATAGCCTCCCCGGGAAAACCGACGCCTT<br>CATGGGCTTGGACGTAACTTACGACGAGAGTAGCGAGCAGCACGCAGGCGCCAGTGCAAGCGTAGTACTCGCGGATGGGACGACTT<br>TCGCAGCCGAGAGCACCACCCAGCAAGGTGGCGAGAAGTTCAGTGCCAGCGCATGTAGAACAGTTCGTGAGGGACCTCGTCTTCGAC<br>TTTGCGGGGGAACAGGGCCGAGACATCGACAGACTGTGCATAATGAGAGATGGGAAGATCAGCGAGGATATTGACGCCGTAAGAGA<br>GGGACTCAGTGGTATTGAGGCGGAGATCGACATAGTTGGCATACGAAAATCCGGCAACCTCGCATAGCTGAGTTTGACGGTACTC<br>GGTTTCGGATCGCCGAAAAGGGCGTGGGCTTTGTGGACGCCGACAGAAGCCAGTCTATCATCCATGCATTCGGCAAACCCGAAATC<br>CACGACGACAATCCTGTGGGCACCCCACGAACCTTTCGACTGACCAAGACTCTGGTCCCACAGATGTGGAGACCCTGACCCGACA<br>GGCATACTGGTTGTCCGAGATCCATTTTGGAAGCCCCGTTAGGTCCCCTAGGCTCCCCGTGCCAATAGAGTACGCAGACATGGCTG<br>CTGAGTATGTTCGGGAGGAGTACGTCTCACCAGGGACTGTAATAGAAGGGCCAGCATACATCTAGTAA |
| 151 | ATGCCTAAGAAAAAAGGAAGGTTGAAGACCCGAAGAAGAAACGCAAGGTCGGCAGCGGAAGTATGAAGACGCAGGATGATATCGC<br>GCACAAGCAACCCATTACCATCGAGGTCCAGATCCTGAAGGAGCTCGACAAGCCAAGCCCAAAAATGGCCACCCGGTTCCTCGTGG<br>CCGATAGGGACGGCAACAGGTTTAGCCTGGCTATCTGGAAGAACAACGCACTCAGCGACTATGACTGGACGATTGGCCAGTGGTAC<br>AGGCTGGAAAACGCCAGAGGAAATGTCTTTAACGGCAAACAGTCCCTCAACGGTAGCAGCAAAATGCGCGCCACTCCACTTGAGGC<br>CAGCGAGGAGGACGAAACCAGCACGGATGATGTGGGACGGGTCGACACAATCCTGGGTAATATGAGCCCGGACCAGGCTTACCTGA<br>GCCTGTTTCCCATCAGTAGGTCTTTTGATACCCTGTCTGTGTACGAGTACAGCATTGAGGCAGCCGAGGCATTCGAGGATGCGCCG<br>GACACCGTGACCTACAGGTGCGCTGGCAGGCTTCGGAGAATCACGGGTGCGGGGTCGCTTATGCTGGCTCAATGAGGATCGTGTC<br>AACCCGCAAACTCCCGGACAAGCTCGCGGACCCCTTTAGCTTGAGTGAACCCACGGAGAGGGAACTGAACGCTACGGACGCCAGGG<br>ACAGGCATAGGATAGAGCGGCTTCTGAAGAGCCTCGTGAAGGCCGCCATCGACGATGCACCTACGACCCATACCAGATCAACCGA<br>ATCAGGGCCAGGACCCCGAGCATTACCGCTGGCGACGGGCTGTTCGAGGCGTGCTATGAATTTGCAGCAAGGGTCGATGTGATGCC<br>CTCCGGCGACGCCTTCGTGGGAATTGAGGTAAGGTACCACACGCGGAGCCAGGTCACTGCAGACGTTTACGAAGACAAAACCGCGG<br>AACTGGTGGGCACCATCGTGGAGCATGACCCAGAGAGGTACAACATTAGCGGTACGGGCCGAGTAGTGGGTTTCACTGACCACCAC<br>TTCACCGACGCCCTCGACGAATTGGGCGGTCTTAGTTTGGCGGACTGGTACGCGCAGAAGGATCCGCGTCCAGAGGGGGTATTGGA<br>GGCGCTGCGAGAGAAAAATCCTAGGTTGGTTGATATTCAGTACCAGGAAGACGAACCAGCCAGAATCCACGTCCCGGATTTGCTCA<br>GGGTAGCACCCCGCAAGGAAGTTGTCAAGGAGTTGGATCCCGCCTTCCACAGAAGGTGGGATCGAGAGGCCAAGATGTTGCCCGAC<br>AAAAGGTTCAGGCACGCCATAGAGTTTGTGGATCATCTCGGGTCCCTGCCGGATATAGACGCCACGGTGGCACCCGAGCCTTTGGG<br>GCCGTCACTGTCTTACATGAGCACAGCAGTCGACAGGGAGAAGAACCTGCGCTTCAAAGATGGAAGGACCGCCACCACCCCGTCAA<br>GCGGCATCCGGAGCGGCGTATACCAACAACCGACGAGCTTCGACATCGCCTATGTGTACCCCACCGAGTCTGAACAGGAGAGCAAG<br>CAATTCATTTCTAACTTCGAGAACAAACTGTCCCAGTGCCAGTGCGAACCAACTGCCGCTAGGCACGTTCCTTATGAACTCGGCGG<br>CGAGCTGAGTTACTTGGCTGTCATCAATGAACTTGAGAGCGTGGATGCGGTGCTCGCTGTGGTGCCTCCCCGAGACGATGACCGGA<br>TAACGGCCGGAGACATAACTGACCCCTATCCCGAATTCAAGAAGGGCCTCGGGAAGCAGAAAATACCCAGTCAAATGATCGTGACC<br>GAGAACTTGGGCACAGATGGGTGATGAACAATACAGCCATGGCGTGATCGACAGGGACAGGAGGCGTTCCGTGGAGGGTGGATGA<br>GATGCCGGGTGAGGCCGATTGCTTCATAGGACTGGATGTGACTCGCGACCCGGAAACCGGCCAACACCTTGGCGCTAGTGCCAATG<br>TCGTTTATGCCGACGGAACCGTTTTCGCCTCTAAAACGCAGACCCTGCAGAGTGGGGAAACGTTCGATGAGCAGAGCATAATCGAC<br>GTGATCAAGGATGTATTCCAGGAGTTCGTTAGGCGCGAGGGGCGATCCCCTGAACACATTGTTATCCATAGGGATGGCCGGCTGTT<br>TGAGGACGCCGACGAATCCAGGCCCCGTTCGCGGATGACGGGAGTGAGCATAGACATTCTGGACATCAGGAAATCTGGCGCTCCGA<br>GGATTGCCCAATACGAGGACAACAGCTTCAAGATTGACGAGAAAGGCCGACTTTTCATCAGTCAAGATGACACGCATGGATTCATC<br>GCCACAACGGGAAAGCCGGAATTTGATAGCGACAACCTGGGCACTCCCAAGACTTTGAGGGTAGTGAGGCGGGCTGGTGACAC<br>ACCGATGCTGACTCTGCTGAAGCAGGTGTACTGGCTTAGCGAGGCACATGTTGGCAGTGTGAGCCGAAGCGTTCGCCTGCCTATCA<br>CAACTTACTATGCAGATCGCTGCGCCGAACATGCGCGGGAGGGGTACCTGCTCCATGGCGAGTTGATCGAGGGTGTGCCATATCTG<br>TAGTAA |
| 152 | ATGCCCAAAAAGAAGCGCAAGGTAGAAGACCCAAAGAAGAAACGGAAAGTGGGAAGCGGCTCAATGGAAGTGTCCCCCTTCTTCAA<br>CGAACTGTTCAAGTACTACATATTTCTGTTTTTTGGTTTCAAGGTGAACATCGTGAAATCACATTACCAGAGCATTAAGAAGCACA<br>AGATAATATTCTATTCCGGTGGGATCATGGACGAGTATTACACTAACGCCTTCCCCATCAACAAATACTTTATCAACCGCATCATC |

TABLE 17-continued

Argonaute nucleotide sequences containing 2X Nuclear localization sequence (NLS) from Simian Vacuolating Virus 40

| SEQ ID NO | Sequence |
|---|---|
| | TCTGAAAACTGCATCCGCTGCCTGTGCAAAATAACCAAGCTCGAGAAAAAAGAGAAGATCGAGGAGTTGCTTTACTCTATCAGCGC<br>CACCCTGGGGGGCATTTACATCGACGATTACAACCCAATGAAGAATAAGTTCAGCTTCTACATTTGGAAGGGAATCCTGAATAAGA<br>AGATTAAATCCTACGGGTCTGAATGGCTCATTAACAAGATGAAAAACATGGGCTTTAAGGATCCGGAAAACAAGACGCTGTTGAAC<br>TATGTGAAAAAAAGTACGAGAAAGACATAAAGTTCGACATCATAAAGAAAGAGAAGATAGAATGGAGTAACCTCGACTGGGAGAT<br>AAAGGAAAGATAGTGCTGGGCGCCATAAAAACTCACCCTACCATTCGCAAACTGATTGAATACAAGAATGAGAAATTCATTGACA<br>AAATTGGAAAGAAAATTCTGACTTACTTTAGCATCACAATCACCAGCGACGAGAACGAGAATTACTTTCTGATCGTCAAGCCCAAG<br>CATAAGATCATCAGCTCAGAGACAATTTACAACATGCTGAAGAACAACAAAATCGACTTTAAAACTCTTGAGAGGAAGCTGCTGAA<br>CGGCAGCGCCCTGATAACCACCAGTAGGGCAGTCGGCAGACGGAAATACGTCAAAATCAAAAAAATCATATCCCCCAAGGAGAAGG<br>AGTATTGGCAACATACCCAGGACATCAATGAGCACTACGAAAAGGAGGGCGTCCCGATCAGCGTCGGCGGTGACGACATCCACTGC<br>TATATCTTCATCGGGGAAGACGATTACGCCTACCACACGAAGAACTCCTTGCTCTACGAGGGTGTGACGGAGGACGTGCAGAAAAT<br>ACTCTTGGATATGGGTAAGTTCCTGGAGGAGCTGGAGACGGCAAAATCTATCCTCAAGCAGGGCAACCTCATAGACTTCAGTCGCG<br>AATTCCTCAACATTAGCACGAAGGACGACTACACCCTTACTCTCCTGAGCACACTGTCCGATATCAAAGTGAAGCTTAAGACCGAG<br>TCTGGTATCATCACAGGCGACTACCAGAAACTTAGGGAGATCTTTGACTGGATCTTCGACAAGAGCTTTAACCCCTTGAAGCCTAA<br>GAATTGCTACCTTCCGCTGAGTATTCCCCCCATACTGAATGACAAGAAAAAGATCGGCGTGTACATCTTCTATAGCAATATTAGCG<br>ACCCCGAGCTTAGGTTTATCGAAGGGATCTTTAAGAAACTGGGCCTGATATGCGCCATCAATAAGAGTGTGCCAAAAATTGAGGTT<br>AAACTCAAGAAGGAAGTGGACTTTGAGGACTACGCCAACAGCAGGATCATAATCACCCAGACCGTACTGAGCAATCTCGAGGATGG<br>CGAGCAGCCGTTCCTCATATGTATAAGTCCCTTGCTGCCGAATAACGAGTTCGATGAACTCAAAATGCATCTGTTCTCTCACCCGC<br>AGCTGATATTTCACCAATTCATGTATCCGTTCAACCTTCGAAAGTGCCTTGAGAAAGAATCATTCAAGAAACCCTTCATCAACTCA<br>ATCCTGTCTCAGTTCTTTCACAAAATGGGCATGTACCTCTTTAGTCTGTCTGACGAGCTGGGGAACTACGACTTCATTATTGGTTA<br>CGACATAAGTAGGGAAAAGGATGACATCGGGAAGATAAAAGGTATCGGCGGCTCCGCGATCATCTACAACAATTACGGCCATGTCA<br>AGTCAATCATAACGTTCGACGACGTAGGGTCTAGCGAGATAGGCAGGTACGACCTCCTGTTCGCGCAGGTGCACAGCGAACTGATA<br>CCCCACCTGAATCTGAACAATAAGCGGAAAATTAAGATTCTGCTTCTCAAAGACGGGCGGATTTTCAAAAAGGAACTCGAAAAGCT<br>CAGCCAAATCAGCAAGGATATAACTTCGAGATCACCTACATTGACGTTCGCAAGAGCACACGTTCGCTGCTCCGGTTCTGGGGTGTGCGGA<br>GGGGCAAAGTGGTGCCCGAGTATAAGAATAGCTACGGGAAGTTCGGACGCGCATACTATATTAGTAGCCATTACTACAACCGCTTT<br>TTCAAGCAACCAATCGCAATCGTGGAGAAGTACCACATAGACGAGGGCAATTACAAACGCGTGGAAATAGAGGAGAATGATATTAA<br>GCAGCTGGTTCTGTTGACCAAGATTAACTACAGCCAACTGATGCCAGATAAGATGCGGCTGCCCGCACCCGTTCACTACGCACACA<br>AGCACGTGAACGCCGTGCGACGGGCTGGAAGATCAAGGACGTCTCTATACTGAGGAGCGGGTGTCTTCCTACGATCTAGTAA |
| 153 | ATGCCTAAGAAGAAAAGAAAGGTGGAAGATCCAAAGAAAAAACGCAAGGTGGGTAGCGGCTCCATGACTAACAAAACCAAACAAAA<br>AAGCAGGAAGCAGAGGTCCCTCATAGAATTTCTTAAGGTGAAGAAGATCAACAAGGAAGATGGTAAGAACCATAACCTGATCAAGT<br>ATAGCACCGAACGGATCGATACAGGAGTGACCCAGAGCCTCATTGACATCAATATATCCAGTAACATCCTTAAGCTGCGGGGCAGC<br>ATTGCTCAAGAGGTGTTCAAACAGGAAAATTGGCGTTTACTACGGGCTTGGGAAGTATTACGTTGCCGAAAACAAGCTGAAGAACAC<br>CGATCGAATGGATTTCTTGAAGAGGGTCTACGAGACCTTCCCCTATAACTACCTCGATAAACAGGACCCGCACAGCAAGATCAGCT<br>TTTACGAGTACTACACATTCCAGAAGTCCATCGACAAAGACGTGATAAACCTGCTTGAGCTGCAGAAGATAAACGAGTATAGTTGG<br>GACATACTGGACCCACACATCGCCACGCGCCTTCTCACAAGCTATGTGAAGCTTTACTTGGGCGACTACTTGAAGCCAATCCTGTC<br>CTCTTTCGAGTACGTCCGGGCTCGAATCAAGACAAAGCAAAAGACCGTTCCAATCAAAATCCCCGTGACCAAGAAGTTCGAGATCC<br>GAACTTTGGGGTACGACCCGACGCAGAGCGAAATTACTCTCGCCATAAAACGACACGCCAGCATGAACGCTGTGCTGTTGAGCAGC<br>TTTCCCCCCGACATCCTCGCGGTTGTGATAACTAAGCTCAAACGCCTCGTGAACGAGGCCGTGAAGCAAGACTACCGAAAGGTCAG<br>AATATACTCCGAGACCCAGCCGGGGAGCGGTACTGCCGCAGTTGTTGAAATCATCAGCGGCAGCCAAAACGTGATGAAGTTTCTCG<br>AAGAGCATCCGAAGGGGGCCATCCACGTTGAAAAGCGACTTAAAGAGCTGGGTAAATCACTGCAGGAGGTCCGGTACCTTCTTATC<br>GGCGTCTATGCAACAACGTCAGCCTGGAGCGGGCAAAAAAAGACGAAAGATACCACTACTACTTCACCGAGCATAACGCTTACCT<br>TGTACTTACGCCCGAGGTGCAAAAGGCGCTCTTTGGCAAGTTGATCGACGACTGGAAGACAAGCATTCTGAATGAGTACCAAAATA<br>AGCTCCACGAGATCACGAGTCTTGGGATGTTTAAGCATTTGGAGACCATACGGGGCATCCCGGTTTCCTTGAAAGAGAGGCTTGTG<br>GTCCGCACCAGCGAGGGCTTGCAAACCGTAGATGACATTAGGGACATTTTGACCAACCCCAAGATTCTTAGTAATATGTTGCCTAT<br>ATCCGAGGACGCGCTCAAGGAGACGCGAAAGCATAAACTGCGAATCACCCTGTTCTGTCCGGAGAAGTTTAGTGAGAGGATTCACC<br>GGACTATTTTCTACGACAAATTGAACCAGTTTCGAGACGGTCTGCTTAGCAACAGCTTCGCAAGCGTGGACGAAATCGAATTGTTC<br>CAGGTCAAAGGCGAAAACTCTAGCGATTATGAGGAGATCATGAAGGACGCTGGCCTTGATAAAATCCACGATTATACCCTGGCGGT<br>CATCATATTTCCCGAACATTATATAAGCGCAACCTTGAGTTGCGACTCTTTTACAACTGGCTGAAAATGCGGTTCTACTCAGAGA<br>ACAAGCCACTGGTTTTCCAGGGCGCTCGGATTGACAGCGTCTTCGGCCGGTATGCGAAGTACGCATCATACAACCTCATCTTGCAG<br>ATCCCACCTAAATTGGGCATCTACCCGTACTCACTGAGGAGCACGAGGACTATGACTACATCATCGGCATTGATTACACCTATTG<br>GTACGAGAGAGATACGCCTAGTCTGGGCGGTGGCGCCGTGTTGACCAGCCCGTCAGGGCTGATTGAGAGCATATACCCCATCGCAC<br>TCCCGAGCCGCACTGAATCCCTCAACATGTCCAAGATACTGAGCGAATGGTTCACGCGAACACTGTCAAAACGAACCGGCATATCATA<br>GATAAGGGCCACGTGACCGTGCTTATCTCCAGGGACGGCATGATTCCTAAGTACGAACGCCAGACAATCCAGGAGTTCCTGAGTGA<br>ATATAGCGGCGACATGGGCATGACCATAGAGGCAGTAGAAGTTAGGAAACGCATCGCCGTGAGGACCTGGGCTACACAAGAGCCCG<br>TGGCCTACTACAGCCCGATAAAGGTTGGCGACTGTACCTACTATCTGGTCGACGCGCACACCGGATACCCGCTGGGGGAGAAAGGG<br>AACCGAACCTTCTACAGCTCACCCTATCTCATAGGAAGTTTTTACAGGTTCGAAAAGGGCAAATCCTCCCCCGTGCCAGGTAGCGC<br>AAAGAAGCACGTGATCGAAAGCCTGATAAGACTTCAAAAAAATCAATTACGCCACCACCCGCATGGATAACATCAAGTTGCCCCTGC<br>CCGTCGACATCACCCACAAACTCATTAACTTTATCCGGGACACCAAGATGGAAATCAAGGGGGTCGGTATCCCAAACAGTCTCTTT<br>ATGATATAGTAA |
| 154 | ATGCCAAAGAAGAAGCGGAAAGTCGAGGACCCTAAAAAGAAACGAAAGGTTGGCAGCGGTAGCATGAAGAACCTGAGATACAAAAT<br>CAACGCCTACAGAATCAAAAAAGACTATATTCCCAAGGAAGTTTATAGATACAGGATCCGCTCCTTCATAGAGAACATTAACATAT<br>ATAGGTTCGTCGGTTTTTACGGAGGCGTGGCCCTCAATCAATCTGAGTTTATCCTTCCGTACCCGGTCGAAAATCTCGTCCTGGAA<br>TACGACGGAAAAGATGTAAAGCTTGAGCATATCGACACACTGAACCTGGAGGACATCGAGAATAAGGACAAGGAGAAAGCCGAGAA<br>GCTGGTGAGGGGATACCTGACCAGCATATACAAGTTGAAACCCATACTCTACAAGATCCTGCGGGACGTTCGAGAGAGCAAGATCA<br>TTAACGATATCAGAGTGGATCCTATACCCGACTTTACAGTAAAAAGGCACAATAACGAATACTACCTTGTCATCGATTTTAACCAC<br>ACCGCGACCGTGTTGAAAAATCTTTGGGACTTCGTGGGAAGGGACAAGCTGAAACTCGAGGATTATATCGGTAAGAAAATCATATT<br>CAAGCCCAACCCGAAGAAGAGGTATACTATAAAGAGCATTGAAAAGCAGAACAAGAAGGACATTGATGACATTGTCGAGCACATCA<br>TCGAGTACTACAGGTGACGGAGAGGAAAGTTAAGAGCACCTTCGGCGAAATCGACTATACTCAGCCCATCATCCATTGCGAGGGC<br>ATCCCCTACCCGTTCGCACCGCAATTTTGCAATATCGTATTTACCATGGAAGACTTGGATGAGAATACCCTCAAGGACCTGCAGAG<br>CTACTGGAGGTTGCCCAACGAGATCAAAGGCAACATTATCAATCAGATCGCTAAAAAACTGCGATTTGTGGAGAACGAGCCAATCG<br>AATTGGAATTCATTAAGTTCAATAACACCCCCCTTATCGTGAAGGACGAAAATGGCAAACCAACAAAGATATACACCACCAATCGC<br>CTCTTCCGATGGAATTACGATAGTAAATCCAAACTGTACTTGCCCTACGACATCCCTGACATAATCAAGAACAAAACACTGACAAC<br>GTTTGTGCTGATCGACGAGAATCTCAAAAACGTGAGTGGTAAGATCAAGAGAAAGGTCTACCAAATGTTCAAGAATTACAATAAGA |

TABLE 17-continued

Argonaute nucleotide sequences containing 2X Nuclear localization sequence (NLS) from Simian Vacuolating Virus 40

| SEQ ID NO | Sequence |
|---|---|
|  | TCGCCAGCAAGACTGAGCTCCCGAAATTTGACTTCGCCAATAAATGGAAATACTTCTCTAACAACAACATCAGGGACGTGATCCGA<br>AAGATTAAGGATGAGTTCAACGAGGAGCTTGGCTTCGCGCTCATTATGCGGCAACCGATACTATGAAAACGATTATTACGAGACCCT<br>GAAGATGCAATTGTTCAACCTGAATATCATCTCCCAAAACATTCTCTGGGAGAATTGGTCAAAAGACGATAATAACTTCATGACAA<br>ACAACCTGCTCATACAAATTATGGGCAAACTCGGAATTAAGTACTTCGCACTGGACGCAAAAGTGAACTATGACTACATCATGGGG<br>TTGGACAGCGGCCTGGGCGCATTCAAAAGCAACAGAGTGTCCGGGTGTACCGTGATCTATGACAGCGAAGGGAAGATCCGACGGAT<br>TCAACCAATTGACGTGCCCAGCCCTGGGGAAAGGATCCCCATTCACCTGGTAGTGGAGTTCCTGGAGACCAAGACCGACATCAATA<br>TGGAAAACAAAAACATCCTGTTCCTTCGAGACGGCTTTGTGCAGAATAGTGAGAGGGAGGAGTTGAAGAAACTGAGCAAAGAGCTG<br>AATAGTAACATCGAAGTGATCTCAATCCGCAAGAATAACAAGTATAAAGTCTTTACCAGCGACTACGGTATCGGCTCCATTTTTGG<br>CAATGATGGCATATTCCTGCCACATAAAACTACATTCGGAAGCAACCCGGTGAAGCTCAGCACCTGGCTGCGCTTTAACTCCGGGA<br>ATGAGGAAAAATTGAAGATAAATGAGTCTATAATGCAACTTTTGTACGACCTTACCAAAATGAACTACAGCGCTCTGTACGGGGAG<br>GGTAGGAACCTTCGCATCCCGGCACCGATTCACTACGCCGACAAGTTTGTGAAGGCCCTTGGAAAGAACTGGAAAATAGACGAAGA<br>GTTGCTGAAGCATGGCTTCCTCTACTTCATCTAGTAA |
| 155 | ATGCCCAAAAAGAAAAGGAAAGTGGAGGATCCGAAGAAAAAGAGGAAGGTAGGCTCCGGGAGCATGAAGCCAGTGAACTTGGATGA<br>AAACAGCCTCAACGACGTCCCGGTAGGCGACACCTATGCTGTCCGCTTCACTCTTGATGCAGTCTTCGAGAACGAAGGGCAGTATC<br>CCCGGAGGAATCTGAAATTCACAGACGGAGGGGGGGATGACCGAACCATCACTATTTGGAAAAACTCTGCACCCGAGGGAAATTTAC<br>GAGGCGGACTATGAGCGCGGTGCGACGTATCTTATTACCGCCGTCGAGTATGACATCGACGAAGGTAATGACGGCGAGCGATACCA<br>GAATCTCACAGTCCAATCAGATGCTACCTTGCTGGAGATGAGCGGTCCCCCTAGTACCGAAGAGGCCTTGGAAGACGGCCTCGCCG<br>AAACCCCAGATACTAGCGCCGATTCAGGTGACCACGGGTTGACAACCTTTAGGACTACAGACGACCTGCCGGATTATGACGTCTAT<br>GAGTACGAGCTGGTGCCGAAGCAAGGATTCCGGCCGTCCGGAGAAAATGCCCTCCGAGCCACATACAGGGCACGACGCAAGGTCCG<br>CCAGCAGTTGGACGTAACACCCGTCGTGGTCGGCGATGCGTTTAAGCTTGTGTCTCTGGTCAAGCTGGCCCACGAGCGGGTCGAGC<br>TTCCGCGATTCAAGATCAACGAGGTTGACGAGAGGCCCATCGTCTACGCCGATGAGGATGACAGGGATGTGTTGGGGGAAATGCTC<br>GGTGAGATCCTCAAGGACGCGAAACGGGACCAGTACGACATCCCAGTGCATCGACAAAATACTGGAGCCAGAGCCCGTCATAGAGAA<br>AGAGGGCTTCAGGCTCCACGAACGGTACAACCTGACCGTGGAAGTTCTCCCTAGCAGGGCCGCTTACCTGCACGTGGACTATCGAC<br>ATCGGATATTGAGCGACAGGACCCTGGATCAACTCGATGAAGACGAAATCCACCCTGGCCTGCGCGTGACCCCCTCATATAGGGAC<br>ATGGGTCTGTACGTTATAGGCGTTGGGCCGGAGACGGTGACCGATAAGCTGCATATCGAGGGCAACAAGAGCCTGGTCCAATACCA<br>TCGGGAAGAGCCGTGGGTGGACCCGGCGAAGGTGCAAGAAATCAAAGACGCAGATAGGGAAGTGATCTGGACCGTGAGGCAACGGG<br>GCGATGGCACCGAGATGGCATTCCCGCCGGAGCTGCTCGCGCTTCAAGGGCACCCCGAAAATTTGGCCCAGTTCGCCAGCGACTTT<br>GCTGAACAACAAAGGCTCAACACGCGCCTTTCCGCTGAGCAATGCATCACCAAGGCTAAAAGGTTTGTGGAGCGACTCGGGCCCTT<br>GCAATTCGACGGACACACTGTGGAATTCGAGACCAACCCGCTGTGGGCGATCGGAACATAGCCATAGATGGTCTGTTTCACCCGG<br>AAGCAAACGTGCTGCAGTTTAGCGGAGGCCAGACCGGCACCCACCCCTCAGATGTGACACAGCTGGGCGTGTACGAAGCCCCGGAC<br>CCCTTCAGGGTGTGCCACATCAGGATGGAGAAGCGGGACAAAGAATACAGAGGGGTTGGAGTACCTTGGAGACGAAGCTGGAGCA<br>GATTGGAGCGCCTCCCGACAGTGTCGAGGAGGTCACGTTCGACGCCACAATGAGCCCTGACCAGTTGGGTATGGAGATAGCGGCCG<br>AGATACCGGACGACCATGATTACGACGCGGCCTTCTGCACATTGCCACCTAAAGACACCGGCTACTTTGACACCGCAGACCCCGAG<br>CGAGTTTACGATGAACTTAAGAAAGTGTTGGCCACCAAAGACCTTAACTCCCAATTCGCGTATGAAGCAACGCTGGACGAGCGCTT<br>TACAATAATCAATATAGCACTGGGTCTTGTCGCCGCAGCGGGAGGTATTCCGTTCACAATCGAGAGGGCGTTGCCAGGCGATAGCG<br>AACTCCACCTGGGAATCGATGTAACCCACCAATACGACGAGTCCGCGAATGGCAACCACATTCACCTCGCTGCTGCGACGACGGCT<br>ATCCACGCTGATGGAGCTGTACTGGGCTACACCTCCAGCCGCCCTCAGTCTGGGGAAAAGATTCCCCCAAGGAGCTGAAAGAGAT<br>CATCAAGCAAGCGGTGATGGGCTTTCGCACACGCTACGATCGCTACCCAAATCATATAACCATCCACAGGGACGGGTTCGCAAACG<br>AGGACCTGTCCGAGGTAGAAAAGTTTCTGACGGACCTCGACGTTGAATATGATGTTGTCGAGATCAGGAAGCAGGCCCCAGCGCGC<br>GTCTTGAAATACAGTGGTGCCCACTTCGACACGCCTCAAAAGGCGACCGCCGCAATCTACGAAGACATCCCGAAAGCGATTGTAGC<br>GACGTTTGGTGAACCCGAGACTCTCGCTAGCCGGGAGTCAACCGGGCTTCCCCAACCAATCACGGTGGAAAGGGTGCACGGAGAGA<br>CCCCCATCGAGACACTTGCTGCGCAAACCTACCTGCTGAGCCAAGCCCACATAGGCGCCAGTAACGCTACAGCACGCTTGCCCATA<br>ACCACCATGTATGCCGACTTGGCTAGTGCAGCGGCAGCCAGGCAACACCTTCCCCCGACCAACAAGCTGAGGGATAAGATCGGATT<br>CATCTAGTAA |
| 156 | ATGCCCAAAAAGAAGAGGAAGGTAGAGGACCCTAAAAAAAAAGAAAGGTAGGTTCCGGATCCATGGAAGAAAATCTGTATCTTGA<br>ATACGACGCTTTCTTGAGGAGTGTGAAGCGCAACGTGGACGTCCCTCATAGTTTCTTGCTTGGAGCCGGAGCTTCCATCTCCTCCG<br>GAATTCAGTCTGCATACGACTGTATATGGGAGTGGAAGAGAGATATCTACATCACGAAGAATATAAACGCCGCCGAGTACTATAAA<br>AATCATAAAAACGAAACGGTTCGCAAATCAATACAGAAGTGGCTGGACAACCATGGCAACTACCCCATCCTGGATGCAGCAGAAGA<br>GTACACATTTTACGCCGAGAAAGCTCATCCAATCGCTGACGATAGGAGAAAGTACTTCTTTAGTCTGATTGAGAATAAAGAACCAT<br>ATATCGGTTACAAATTGCTGTGCTTTCTCGCTTCACAGGGGATTGATGAAGCTGGTATGGACGACCAATTTTGACGGGCTGATTGTA<br>CGAGCTGCTCACCAGAATAATTTGACGCCTATAGAAATCACCTTGGATAACGCGGAGCGCATATTCCGAAATCAGAGTACTAAGGA<br>GCTTCTCTGCATAGCTCTGCACGGTGACTACAAATATAGCACCTTGAAGAATACTGATACCGAACTGGATAACCAACACGAAATTT<br>TTCAGGAGCACCTCGGAAATTATCACGTAGATAAAAATTTTATAGTAGCTGGTTATAGTGGACGCGACAAGTCTCTGATGGATGCA<br>CTCAAGGCCGCTTATTCCAAGAAAGGATCTGGTAGGTTGTATTGGTGTGGCTATGGTGAGAGATAAATTCTGAAGTGAAAGATCT<br>TCTTAAGTATATTAGAGCGAGTGGGAGGGAAGCATACTATATAGCTACGGATGGGTTTGACAAAATGCTCATACACTTGTCAAAGG<br>CAATATTTGAGGATAGCCAAGAGCTGAGTGAAAAAATCCAGAAAATACTCGAAAGCACGAATCAAACCGAGACCTTCAACACAGAA<br>TTCAAGTTGGAGTTTAAAAAAACCGACAAATATATCAAATCAAATCTGCACCCTATTGTTTTCCTAAGGAAGTATTTCAGTTGCA<br>GATCGAGTATGGCAATGAAAAACCGTGGTCCTTCCTGAAAACACTGACAACTCAAACGAACATTAGCGCCGTACCGTTCAAAGGCA<br>ATGTCTACGCACTTGGTACGCTTAGCGACGAGATCAATTCCATCTTCAACGCGTATCTTAAAAGCGAGGTCAAGAGGGAAGCGATCAGC<br>CGATTCGACATCGAAAACGTCACCGCATTCAAAAACCTCATGTTGACAGCCATATCCAAATATTTTGCTACACGAAAGAAGTGAA<br>CTCTAACTACAAAGATAAGATTTGGTTGAAAAACATCCTGTCCAAGGTGGGGGATATCACTGTTCACAAAGCAATTTTCATATCCC<br>TGTACTTTGACAAGAATTCCCATTTTGGTTATATGGCGTTCGCTCCTACCGTTTATTTGGATTCCGACTGCGAAATTGAGAAGAGT<br>CAAAAGCAATCCATCAGTAAGAATTTGCTTGAGAAGTTGTATAAATAACAAATATAACGAAGACCTCGA/CTGTGGAATGGTATCTT<br>GTTTAATCATAAGAAAGTGAAATTTGAATATCCTCCCTTGTCTGGTACGGGGTTCGAATTTCAGATATCAAGCAACACTGCCTTCG<br>GGGAGATAGACGTGATTGATACAAGTACCGCTCTTACGTCCCCAGAATTATGATAATAAGCAGACTCAGTTCCGGGGAATCCAG<br>TTTTTGGAGCCGCAGCTGATATTTAAGAACATCGCAACGAACTCTGACTTCAAGGATTATCATCCCATGCGAGGACTGATTAACAA<br>CCGACCATATGATGTAAATCTCAACGGGATTATCCACTCCAATGAAATTAACCTCTCAATCATCTGTAGCCAAAGATGGAGAAA<br>GGTTGTTCGCATTCTTGACACAGCTCAATAGTAAGCACAGTACAGAAAATATCAACACTGACTACCTGATAGATTACCCCGGCTTC<br>CTGTCCGCCTTTAATCTGCCCATCAACATCCCAGCCACCAACGATGACGTAGCTGGATGGACATCAACTTCGTAGCAGATAACTC<br>TAAAGAAACACACGAGAACGCTATACGACTCGCGAGGGCAATTACCAATAAGATCGAGAAGATTTCTGCTATACAAAGCGCCAGCA<br>CTATAGTAATCTTTATACCTTTCGAGTGGCAGCCCTTCGAAACATATATTAACGAAATAGAGACGTTTGATTTGCACGACTACATT<br>AAAGCGTTTAGCGCCAGCAAGGGGATATCAACGCAACTTATTCGGGAGGACACCCTTGACGATAAGCTCAAGTGCCAAATATACTG |

TABLE 17-continued

Argonaute nucleotide sequences containing 2X Nuclear localization sequence (NLS) from Simian Vacuolating Virus 40

| SEQ ID NO | Sequence |
|---|---|
| | GTGGTTGTCTCTTTCTTTTTACGTGAAGAGCCTCAGGACCCCATGGATATTGAACAACCAGGAGCGGAAAACAGCTTATGCCGGAA<br>TTGGGTACTCCATAAGCAAGGTAAAGAACAAGTCAGAGATCGTGATCGGATGTTCACATATATATGATTCAAATGGCCAAGGCCTT<br>AAGTATCGCCTCTCAAAAATTGATAACTACTTTCTCGATAAGCAAAATAATCCGTACCTGTCTTATAAGGACGCTTTTCAATTTGG<br>GGTTAGTATCAGAGAGCTCTTCTATCAGTCACTCGATTCTCTGCCAGAAAGGGTCGTCATCCATAAAAGGACAAAATTCACCGAGG<br>ATGAGATCAATGGGATAAAGGCTTCACTCAACCAGGCTGGTATTAAGAAGATTGATCTTATAGAGATCAACTACGATATAGATGCA<br>AAATTCGTTGCCATGAACGTGTTCGATAACAAATTGCAGGTCGATAAATTCCCGATATCCAGAGGAACATGCATTGTGACAAATAA<br>ACGGACGGCGTTGTTGTGGACGCATGGTATAGTACCTTCAGTTAAGCAGCCCAATTATAAGTTCTACCTGGGCGGGCGCTCTATCC<br>CTGCGCCCATAAAGATTACCAAGCATCACGGAGAAAGCAACATTGATGTGATAGCTAGTGAGATCCTCGGACTCACAAAAATGAAT<br>TGGAATAGCCTGGATCTCTACAGTAAACTTCCCTCTACGATAGATTCTTCTAACCAGATTGCTAAGATAGGAAAACTTCTGTCTCG<br>CTTTGAGGGCCGCTCATATGACTACAGGCTGTTTATTTAGTAA |
| 157 | ATGCCCAAAAAGAAACGAAAGGTCGAAGACCCTAAGAAAAAGCGCAAGGTAGGTTCAGGCTCTATGTCTGTGGACGCTATGATCAG<br>GAGTATCGGGGTCGCACGGGACCGCCCGCTTCTCGTTTTCCTCGGGGCAGGTGCCTCAATGAGCAGTGGTATGCCGTCCGCCACTC<br>AATGTATCTGGGAGTGGAAACGAGAAATCTTCTTGACAAACAACCCCGACGTTGAGAAGACCCAGTTCTCCGAGCTGAGCCTTCCC<br>AGCGTCAGATTGCGCATCCAAGCATGGCTGGATCGGCAACGACGCTATCCCGCTCTTGATCATCCCGACGAGTATTCTACCTACAT<br>AGGTGAGTGCTTTGCACGCTCTGACGACCGCAGAATCTACTTCGAGAAGTGGGTCAAACGCTGTAGTCCGCACCTTGGATACCAAC<br>TGCTTGCCGAATTGGCACGGCAGGGGCTTGTGGCCAGCGTTTGGACTACTAATTTCGATGCCTTGGCGGCTCGCGCAGCTACGTCC<br>ATCAATCTCACTGCAATCGAGATTGGAATTGATTCACAGCAAAGACTGTACCGGGCGCCGGGCGAGGCGGAACTGGCGTGTGTGAG<br>TCTGCATGGAGATTATCGGTATGATCCTTTGAAAAACACCGCTCCAGAACTCATAAAACAAGAGAAGGAGCTCAGAGAGTCACTTG<br>TCCAAGCGATGAGAACTCACACAGTCCTGGTTTGCGGCTATAGTGGTCGGGATGAGAGTGTCATGGCAGCGTTTTCCGATGCCTAT<br>GACGCAGCTCATTTTAAGGGTCATCACCCCCTCTTCTGGACACAGTACGGCGATTATCCCGCCAGTGAGCCCGTAGCTGGACTTCT<br>TGCTTCACCGCTGGATCAGGAACCTGCGAAGTTCCACGTGCCTGGGGCATCATTCGATGATCTTATGCGCAGGATAGCACTCCACG<br>TGAGTGACGGTGAAGCGCGCGAGCGGGTGCGGAAGATTCTTGAGAACTTCAAGACGGCACCAGTTAACCAGAAGCTCCCCTTTGCC<br>TTGCCTAGTCTTCCTGTGACGGGTCTCGTCAAGTCAAACGCCATTCCGTTGATACCGCCTGGAGAGCTTATAGAATTTGATCTTGT<br>CCGGTGGCCGCCGTCCGGTGAAGTTTGGAGCACGCTCCGGGAAATAGGGGATAGACACGGATTCGTAGCTGCCCCTTTTCGCGGGA<br>AGGTGTATGCTCTGGCTACGATAGAGCAACTGACACAAGCCTTCGCGGACAATGTAAAGGATGGCGCGTTCAACAGGGTGCCGCTG<br>AATAATGATGACCTCCGCTACGAGGACGGAACCGCCAATCAGCTGATCGCGACGCGCTACTGTTCTGGCTTTGGCTGGGAAAGCTGG<br>ATGCGCAACGATGGGGATGCCATTGTGTGGGACACGTCTCGCTCAAAAACCGAAAGATTGGATAGGCAACTTTGGACTGTATACG<br>ATGCAGTACTTCTGCAGATTCGGCCGCTGGGAACTAAGCTCGCGCTCGTACTTAAGCCTACGCTGCGGGTTACGGATTCAACTGGC<br>GAGGTAGCCCCGAAAGAAATTGAACGGGCAGTCAAGGTGCGCGTATTGGGATACCAGCATAACAAAGAGTTCAACCAGGCGACCGA<br>CTTTTGGAGGAAAAGGCTCCTGCCCTCAAGAGATCTCCTTGTCAGATTTCCTGATCTGGATGGTGGAATGACTTTCACGATTTCAG<br>GTCGGCCAATATTCGCCCGGCTCACCGACGAAAGGACTGAAACTGTCACACTGAACGATGCCCAAGAGCGATCAGCATCTCAAGTG<br>GGGTTGCAGCTTGCAGAGCCTAAACTGGTGTTTGCACGCACTGTAGGTACGGGTCCCGCAACGGACACCCTCCCGGTTAGAGGATT<br>GCTGCAAAATAGACCTTTCGATGCTAATCTGACAGACTTGGGCATCGCGACGAACCTGAGGATCGCGGTTATTGCGCCCGCTCGGG<br>ACGCCAGAAGGGTACATGACTATCTTGGGCAGCTGCATCAGCCTATAGATCCTACAAAGTGGGATGCGGACTATCTGATGAGGTTT<br>CCCGGCTTCAGCTCCGCTTTTAAATGCCCTTTGGACATTCCGCAGCCGGGCCAGGCAGCTTTTGTAACACTTGACGAGCCACACGA<br>TGAGAGTCCTCAATCAGCGCGGACCCTTGCAGGCCGAATCACAGCGGCACTGTCTGCATTGAGGGCGACGGAGAATCCCTCTGTTA<br>CAATAATATATATTCCGGCGCGCTGGCACGCGCTGCGAGCATTCGATCTCGAATCAGAGCAATTCAATCTTCATGACTTTGTTAAG<br>GCCGCCGCAATTCCAGCGGGCTGTTCCACACAGTTTCTGGAGGAGTCAACTCTTGCAAATGGCCAACAGTGCAGAGTGCGATGGTG<br>GCTTAGCCTCGCTGTTTACGTAAAGGCAATGCGCACCCGTGGGCTTTGACGGGACTCGATAGGGACTCTGCCTTTGTAGGGCTGG<br>GCTTCTCTGTAAGACGAAAGATCGATGGCGAAGGTCACGTCGCGTTGGGTGTTCTCATCTTTATAGCCCAAATGGTCATGGTTTG<br>CAGTTCCGCTTGAGTAAGATTGATAATCCGATAATGCTGCGAAAAAATCCTTTTATGTCCTTTGACGACGCTAGAAAGTTGGGCGA<br>AGCCATCAGGGAATTGTTTTTTGACGCCCACCTCCGGCTGCCGAATCGCGTAGTTGTTCATAAACAGACCCCGTTTCTTAAAGAGG<br>AGCGGGAAGGGCTCCAAGCACGTCTCGAGGGAGTCGCGTGTGGTGGAACTCTTGCAAATTTTTGTAGACGATACGTTGCGATATGTG<br>GCTAGTCGACCAATGCCGAATGGAGATTTCGAAATCCATGGCTATCCTATCCGAAGGGGCACCACAGTAGTGGTCGACGACCAGAC<br>CCCATTGTTGTGGGTACACGGCACATCAACCGCGCTCAACCCCCGGCAGAGCTATTTTCAGGGCAAACGCCGCATACCGGCCCCCC<br>TTGTGATGAGGCGGCACGCGGGACGTCTGATCTGATGATGTTGGCGGACGAAATATTGGGACTGTCCAAAATGAATTTTAACAGT<br>TTTGACCTGTATGGCCAACTCCCGGCAACCATCGAAACGAGCCAAAGAGTCGCGAGGATAGGCGCTCTGCTGGACCGCTATACGGA<br>ACGGTCATACGATTATCGACTCTTTATGTAGTAA |
| 158 | ATGCCTAAAAAAAAAGGAAAGTCGAAGATCCGAAAAAGAAACGCAAAGTAGGGAGTGGTAGCATGATCAAACACCTCAAGTTCGA<br>CGAGTTCCTTCGCAGCGTGTCAATTAGTAAGGATAACACGTACTCCATGCTTATCGGTGCCGGGTGCTCAATCACTAGTGATATCC<br>AATCTGCCTATGACTGCATATGGGAATGGAAGAAAATAATTTACAAGTCCAATAACTTGAATACTCAGGACTGGATAGAGAATTAC<br>AAATCCCCCAAAACACAAGACGTGATACAAAAATGGCTTGACAACCAGGGAAACAACCCTGAGAAAGATAATATCGAAGAGTACTC<br>ATTCTACGCAAAGAAATGCTTTCCGATAGATGAAAATAGACGCCAGTACTTCCAAAAAATCTGCGCTAATAAGAAGCCCAGCGTCG<br>GATATCGAGCCATTCCTCTCCTGGTGAAGCAAGGCATGCTCGACTCAATTTGGACAACCAATTTTGATGATCTTGTTAATGTGGCG<br>TGTATAGGTGGTGGCGTTCAGGGGATTGACATATCCCTTCAGACGGTAAACCGCATAAATCAACGCAATCAAAGCAAAAATGAACT<br>GCCTATTATAAAGCTCCACGGGGATTTCAAGTATGGCGACCTTAAGAACACGAGTGAGGAACTTCAGAATCAAGACGAAACGCTTA<br>GATCAAAACTTTTGGACTACTTGAGCGATAAGAATCTCATAGTCATTGGCTATAGTGGTCGGGACAACTCACTCATGGAGAGCTTG<br>AAAGAGACTTATTCAAAACCTGGTGCGGGAATATTGTTTGGTGTGGGTATGGGAACAGTCCATCAAACCAAGTGAAGGAACTCCT<br>TAAATTTATCAAGGATAAGGGCGCAGCGCATTCTATGTTTCCACTGAGGGATTCGATAACACCATGCTGAACCTGACCAAGCATG<br>TTATTGAGGACGATGATAACCCTCAAAGAGGAATTCAGAGAACTCAAGAAGAGTATCATTAATAAAAATACAACGACCCCGTTTACG<br>TTGAACCCGGAACGAATCAATAAGGTACTGAAAAGTAACCTCTTTCCTATTACATTCCCAAAGAGATCTTCGTATTCAATGCGAC<br>CTTCGATAAGAAACCTTGGGAGCTTGTTAAGGAAAAAACTCTGAGTGACTATGAAATTTCAGCGATTCCATTTGAAAAAGACATAT<br>GGGCATTTGGGACTGCTAATAACGTCTACGAAAAGTTTGCAGATTTCATTAAGGGCGAGATCCAACAGGAGCCCCTGACCGATATC<br>CGGCTTTATAATCACAACATAAAGTTCCTGCTCCTGTCAAGCCTCTGCAAGCTGTTCTCAAAAACCTACAATCTGAAAACGGACTT<br>TCGGTCTAAGATTTGGGATGAGAGCTCATACAAAACGGTTCACAACCAAAAGGTCTATAACGCTATAAAGATCGATCTCGTCAAAA<br>TACAAGAACAGTCATATTTGTCACTCAATCCAGACTTTCAATTCGCAGATGATAACGTTCCCAATGATATCAACCAGCAGGTTGGA<br>CTGGAATTTTTTCATAAGATCTATAACGACAAATTTAACGACTATATAAACATCTGCAAAAACACCTCGAAACTACGTCATA<br>CGAATTGCCACTGAACTCCGGCACCGGGTTCGTATTTAAAATCTCTAAGAATCCAATTTTCACAAATATAGATGACCTTAATTCCA<br>ACTATACGAACGAGCACAATATACCCATAAACATGATTAAACTTAAGGGGGTTCAATTCAAAGAGACGAACCTCCTCTTTAGTTCA<br>CAAAATGCAGATAAAGTGGTTAAGGAGACCCACCCCAATGAGAGGCCTCGTCAATCATAGCCCGTTCGATAAGCGATTCAGTAGTCT<br>TAAAAACACTACGATCAACCTGGGGATCGTATGCCCCCAACAGGATAGCGAAAATTTTTATACTTTTTTGAATAAACAAAACCAAG<br>AGATTAAGAACGTTAATATTAAGGATCAATATGTAATCGATTACAAAGGATTTCACAACACATACGGTTTGAGTCTGAACATACCT |

TABLE 17-continued

Argonaute nucleotide sequences containing 2X Nuclear localization sequence (NLS) from Simian Vacuolating Virus 40

| SEQ ID NO | Sequence |
|---|---|
| | ACTACGAGCAGTCCTAATTGGGAAATGACTAACGAGCCTGTCTCAAGGGACTCAAAGAAAATAATTCATGAAATCAAGAATAATAT<br>TTGCGACAAGATAAATAAGCTTTGTAGTATAGGCGGACAGAGACAATAGTAATATTTATCCCTAAACGCTGGGACAACTTCGTAC<br>ACTATAATGATGCCGTGGAAAGCTTTGATCTTCACGATTATATCAAAGCGTTCTGTACCGAAAAAAAGGTTACGTCTCAGTTGATA<br>CGGGAAAAGACGATACTCGATAATAACCTCGAGTGCCAGATCAACTGGTGGTTGTCACTCAGTTATTTTGTAAAGTCCTTCCGAAC<br>ACCGTGGGTAATCGACAACACCGACAATAAAACAGCTTTTGCGGGCATTGGTTATTCAGTAGAGTCCAAAAAAGAGGATAAGGGGC<br>ACATTATACTTGGCTGTTCCCATATTTACAGTAGTAACGGGGAGGGTCTCAAGTATAAGCTTTCCAAGGTTAATGATAAAATAGAA<br>TGGATCAAGAAAAAGCCGCATCTGTCCTACGACGATGCTTACGAATTTGGTAAAAATGTGATCAACCTGTTTTACGAAAGCATGAA<br>TGAGGTGCCAAAACGAGTGGTAATTCACAAACGCACCTTTTACACTGAAGATGAGAAGCAAGGCATACTTGACTCTTTGCACGATA<br>ACAAGAAAATAGAAAACATAGACTTGATAGAAATAAATTTCGAAGACAACATAAGGTACGTCTCCTCTAAGATATATAATCGGGAG<br>GCAAAAATCGACGGTTACTCAGTATCACGCGGTACCTGTATCCTTCTTAACGAAAAAGAGGCACTTTTGTACGCCCATGGCGTAAT<br>CCCGAGCGTGAAGAATCCGAGTTATAATTTTTATCCGGGAGGAAGGTACATACCGAAGCCATTGAGGATAATAAAGCATTATGGAG<br>TTGGTTCCCTGGAACAAATAGCAAATGAAATACTGGGTCTCACTAAGATGAACTGGAACTCTCTGAACATGTATAGCCAAATGCCT<br>GCCACGATCGACTCAAGTAATAAGATAGCCAAAATAGGGAAACTCATAGAGAATAGGGATAAAGTAGAGTACGATTATCGGTATTT<br>TATCTAGTAA |
| 159 | ATGAAAATTATAGATAAGGAAACCTTCATCAGAAGTTTTAAAGTTTTGAGCAATCAATCCTTTGACCTGTTCCTGGGCGCTGGCGC<br>CTCCATATCTAGCGGTATCCCTTCCGGAGGCGACCTCGTCTGGCATTTTAAGCGCGAAATACTGAATTCCAACGGGAAGATAAATA<br>TTAAAAAATTTCAAGATCTTAAGATAGAAGATAATAAGAAGGTTATACAAAGTTTCTTTGAGGAGACTGAGGAGAACAACATTATT<br>AATCCTTATTCCTATTATTTTAACAAATGTTATCCAGACCCCTTGATAAGAAAAGAATTCTTCACCAATCTTGTGAGGGACAAGAA<br>GCCTTCCATAGGATTTATGTGCCTGTCTGCTCTCGTGGAGCAGCAAAAAATCAACACAGTATGGACAACTAACTTCGATGACTTGA<br>TTGAGAAGGCGATTAACGGATTGAATTACAAGTCCTGTCAAATTGTCTCACCCGAGAATGCGGGCAGCGTGAATAACTTTCGAACT<br>GATATCCCCACTGTTGTTAAGCTTCACGGAGATTTTAGGTATGACCCACTCCAGAATACTGACGAAGAGTTGCAGAAACTCGAAGA<br>GTCCTTGCATAAGTATTTCGTAGAGCCAAGCACAAAGAGGGGACTTCTCCTAATCGGCTATTCTGGGTCAGATGAGTCTGTGCTGC<br>AAAGCCTTGAGAAGGCGCTGGAAGACAACAACGCGTTCCCTAAGGGACTCATTTGGTGCATCCCCAAAAGTGTCACCCCAAACCAA<br>CGACTGGTCCGAATTATATCTAAGGCTAATGAGCAGAACCAGCGGTCCCGATTTATCATTATCGACAGTTTCCATTATTTCTTGCA<br>TGAACTCTACAAAATATGCGACCTTACGAATGACTATATCGACTCTATTACCAAGGACAGATTTGAAAAAAGCCAGTCATTTAGGC<br>TTAACCAAACTCCGTCCTCTACTCTGCCAATCTTGCTGAACGCAATAAAAGCAAAGCACTTCCCGAAAAGTACCTTTCTGACTAAA<br>ACGAATATCTCAGGCATAGGTAAGTGGAAACGCTTGCGAGACGCTATAGGAAATAGCTCTATAGTCGGATCTTTCGGTAAGAACGA<br>TTCTCTCAGACTTTTTGGAAGTGAACAAGACATTAATAATGTACTTAAGAACTACTTGATTGATGATTTGAAGATCAGTGATATCC<br>CAGAGCACCTTTTTTTCCATTCTGATTCATTCTACATTGGCATGCTTTATGAACTGATTGAAAAGTGTTTGATTAAAGATTATGGG<br>CTGTCAGTATATGCAAAGGGGAGAACTATCAGAAAGTTCTATTCAATCAATAACCCGCTGCCGGAATCTGAAATCGCAGATATTAA<br>GAAGAGAAACAATAATTTTAACATCGACAAAAATATAAATGTATTTGAGGCGTTCGAGTTCTCCATAGAATTCATTAATAAGGAGC<br>TGTTCCTGTTGCTGTGTCCCACCATACATATTCAGACTAAACTCGGAGGTGAGGTCAATCGCAATATCTCTCAGTACCTGTCAAAC<br>ACAATCATCAGCAATAGGTATAATAACAAATATGGGAAAAAGCTGAATTGGTGGATTAACGAGCTCAAGAAGTATAACAAGGACTT<br>GGTTTTTAAATTGGGGGACTTTGAGATACGATTGACAGATTATTACTCCACGAGCGCTAAGCGCGTTAAAGATGACATCTACTGTT<br>TTGACGATTTACTAAGTTGAGTGAGCCCAGTATATATTTCCACTATCAAGACGAAGCAAAGACAGAGTATCCATCCCATAAGTGGA<br>CTGAAGATACTCGGTCCATTGGAAGAATCATTCGAGGCAAACGGTACATCTTCCACAGTCAACCTTGCCATCATTACTCCGGACTT<br>TGGCTTCTCCAAACTCAAGGCGCACCTCGAAAGTTTGCTTAATACAATTTCCCCTATATGGGAGAAGGAATACTTGAAGGAGTTCC<br>CTGGTTTCGATAACGTTTTTAAGAAGCACCTGATAATACCCAATTCTATTCAAAGCGAGTATGTAATCAGCATACCTAATAATGAT<br>GTAAAACAGTTCTCAGCAATTCAATTCTACGACTACCTGAAGAGTAAGATCGACCGACTCGTCTGAAGTCCAATGACATTGATTG<br>TCTTGTAATATACATACCCGACCAGTGGAAGAACTTCCGAGAGCTGAAAAATGAAAACACATATATGACCTTCACGACAGTCTTA<br>AACTCTACTGCGTAAAAAGGGGTTGCGAATCCAGTTCATCGAAGATAAAAGCATTAATTATAAAGACCAAGCCAAGATCCGGTGG<br>TGGCTGTCTCTGGGGCTCTACGTGAAGTCTAACGGCACTCCCTGGAAGATCAAAACAGATAATACAGAGACTGCCTTTGTGGGCCT<br>CGGTTACGCTATACGACAAAATGTTAAGAATAAGGTTGTTCTCGGGTCTTCACAGATTTTCGACGGTTATGGGAATGGTCTCAAGT<br>TTCTTTTGCAGCCCATAGAGAAGCCAATTTTTTACAATAAAAACCCCTTCATGAGCAAAGAGGACTCTTTTCGGCTTATCAGTAAT<br>ATACGAAACACATATCATAAGATCGATCCAGTTATCGGACTTAAGAAACTCGTGTTGCATAAGACAACTCATTTTACTTCAGAGGA<br>GATGGAGGGGATCTCTAATGCTTTGGAAGGCATAGACAATATTGAACTCTTGCAGATTCAGCAATTCTCATCATGGAGGGCAATTA<br>AGCTTATGAAAAATGCCACAAAGCACGATTTTAATGGTTATCCGATCAGTCGCGGAACTATAATTCAACTCGACGACTTCTCTTTC<br>CTTCTGTGGACACACGGGCTTATAGAGAACCAAGAGCTGAACGGTAAGTACTACCAGGGAAAAAGAGGAATACCGGCTCCGCTTCT<br>TATTAAGAGATTTAGAGGCACGGATCCAATAGAGACGGTGGCAAACGATATTCTTAAGCTGACCAAGATGAATTGGAATGGTGCAG<br>AGCTCTATAAAACCTTTCCTGTAACGATTGATTTCAGTAAAAAACTTTCAGTCATGGGGAAGTAGTAA |
| 160 | ATGCCGAAAAAGAAAGGAAGGTTGAGGATCCTAAAAAAAAAAGAAAGGTCGGCAGCGGGTCTATGTTCGACATTGGATCAATGGT<br>GAGAGTTAGGGGTCGAGACTGGGTCGTGTTGCCTGGCAGTTCCGCAGACTTTCTCCTGCTTAAGCCACTCGGCGGATCAGATGCAG<br>AAACGACAGGGGTTTATGCCGGTCCCGGCGGCGAAGTTGTGAGATCAGCGACTTTTGCGCCACCCGATCCGCAAGCGTTTGGAACA<br>GCCTCTGGCGCTCGGCTTCTCCTGAATGCAGCTAGATTGGCCGTTAGGTCCGGCGCTGGACCGTTCCGCTCCCTTGGCAGGCTGGG<br>GGTAGAACCACGCCCATATCAACTTGTCCCCCTCCTTATGGCCCTGAGACAAAGTACCGCCCGGCTCCTTATTGCCGACGATGTAG<br>GTATAGGAAAGACAGTTGAAGCGGCACTCATCGCCAGGGAGCTGCTTGACCGCGGAGAGATAGAGCGATTCGCTGTGCTTTGTCCG<br>CCCCATCTGGCTGGTCAGTGGGTAGGTGAGCTGAGGAGCAAGTTTGGGATAGATGCCGTCGCGGTCCTCCCCGGAACCGCGCGAAG<br>ACTGGAGCGCGGCTGTAACCCAGGCCAATCTGTGTTCGCCAGATACCCTTTCGCAGTTGTCTCTCTCGACTTGGTCAAATCAGACC<br>GATGGCGCCAGGATTTTTTGCAGAACGCCCCCGAGTTTGTTATCGTCGACGAAGCGCACGCCAGTGCTGAGGGCGAGGGGTTGGGC<br>GCGCGAAGACATCAGAGATATCGCCTTTTGGAGGACCTTGCGCGAGACCCAGAGCGACACTTGATACTCGTGACAGCTACGCCACA<br>CAGCGGAAAGGAGGACGCATTCAGATCCCTTTTGAGATTGCTCAACCCTGAATTCGCCGCTCTGCCACTGGATCTCTCCGGCGCTC<br>AAAACGAAAGAGCTCGGGCAGCTATCGCTCGACACTTGGTGCAGCGGAGGAGGGTGACATCACTGCATACCTTCACGAGGACACC<br>CCATTTCCAGTCCGAAGGGACGCCGAGGTTAAGTATACTCTGCACCCCGATTATGCGGCATTGTTGAGGACATTGAGGATGTTCTGGCCTATGC<br>AAGGGAGTCCGTGCACGTTCCAGGCGAGGCGCATAGTCGGACGCGGATACGCTGGTGGGCCGCCCTGGGACTGCTTCGGGCTTTGG<br>CTTCTTCACCCCAAGCAGCCGCAGCCACTCTCCGGGAAAGAGCAAGCACCGAAGGCGAGACTGATGAAGCAGTTATTGAAAGACTT<br>GGCAGGGAACTGGTGCTTGACCCCGAAGACGGTGAACATGGGCTGCTGGACGTCACCCCTGGAGCGCAGGTCGACGGTGAAGAAAG<br>CGGGACCACGCGACGCCTTCTCGCACTCGCAGAGAGGGCCGACGCTCTGGCTGGGCGCCAAAGACCGGAAGCTCGCACTCCTGACCG<br>CACAGGTCAGGGATCTTCTGCGGAAGGTTTCGCGCCGATAGTTTTTTGTAGGTTCATTGCGACCGCGGAGGCAGTAGCGGAGCAC<br>TTGAGGGGAGTTCTGAAAGGAGCTGAAGTCGTGGCTGTCACAGGAAGGCTGACGCCAGATGAGCGCGTCGCCCGCATCGAAGAGCT<br>TGCACCCCACGAGCGACGGGTTCTTGTGGCAACGGACTGCCTTAGTGAGGGCATTAATCTCCAAGCTGCCTTCAGCGCAGTAGTAC<br>ACTATGATCTCCCCTGGAACCCTACCAGGCTCGATCAAAGGGAGGGCCGAATTGACCGATATGGTCAACGATCACCAGAGGTCCGA<br>GTGCTTACATTGTATGGGGAGGATAACAGGATAGATACTCTGATACTGGATGTTTTGATCCGAAAGCATCGGCTGATCCGGGCTAC |

TABLE 17-continued

Argonaute nucleotide sequences containing 2X Nuclear localization sequence (NLS) from Simian Vacuolating Virus 40

| SEQ ID NO | Sequence |
|---|---|
| | CTTGGGAATGGGTGTCCCCGCTCCCGACGAGGCAGAAGGATTGCTTGACGTGCTGTTGGCGCGAGTACTGGAACCCGAACGAAGAG<br>GTTCTATTCAGCCATTGCTTCTGGATGAAGTGCAGGCTTTTGATTTGAAATGGCGCGATGCGGCTGAAAACGAAAAAAGGTCAAGG<br>TCACGATTCGCCCAGAACTCTATAAGGCCCGAAGAAGTAGCAGGGGAACTCGCAGCGGTACGGGAAGCGCTCGGAGACGCTCGAGC<br>CGCTCAGGACTTCGTTCTTGATGCACTGCGAGGGGCCGGTGTTCAGGTGACGCCGCGCCCCGACGGAAGCTTCGAAGCGGACCCCA<br>CCCAAGCCGATGTAGCACCGGAGGTCCGCGACTTTCTGCGGGGAGCAAGGCGCTTCAGATTTGACGCACGGGTAGAACGAGGTGTG<br>ACGCCCTTGGCGCGGAACCACCCATTGGTCGAGCAACTTGCAAGCACTGTACTGGGTCAGGCTCTGGAGTCTCCGCAGGAGGCCGC<br>AGCCAAGCGCGTAGGCGTCATTCGGACCTCTGGCGTAAGTACTCAGACCACTCTTTTGCTCCTTCGATGGAGATTTCATCTTTCCG<br>GACGAAAGGGAAACCGATCTTGGCAAACTCTTGCTGAAGAACTTGATCTTCTGGCTTACGCAGGAAGGGCAGAGGATCCGCAGTGG<br>TTGGACGCTGAGGCCACCAGAGCTTTGCTCGATCTGACCCCTCAGGGTAACTTGGATCCGGTGCAGAAAGAGGAACGCCTTACTCG<br>GACGCTTGAGGGACTTAGCGCTTTGGAGGGGGTTTTGGACCAGCGAGGAAGGGATAGAGCCGCAGCTCTGCTTGACGCTCACGAGA<br>GAGTACGGGGAGCAGCGCGAGGGCAAGGGGTGACCTATTCTGCGGAGCCTCCTGGCCCCCCGGATCTGCTTGGTGTCTATCTCTTT<br>CTCCCCGCACCAAGACTCGGAGGCCTCGCCTAGTAA |

In some cases, a polypeptide construct as described herein can comprise one or more domains. Domains of a polypeptide construct can be arranged in any order. In some cases, a domain organization of a polypeptide construct is in the configuration: (ArgoN); (ArgoL1); PAZ; ArgoL2; ArgoMid; Piwi. In some cases, a domain organization of a polypeptide construct is in the configuration: SIR2; (ArgoN); (ArgoL1); ArgoL2; ArgoMid; Piwi. In some cases, a domain organization of a polypeptide construct is in the configuration: (ArgoN); (ArgoL1); (ArgoL2); ArgoMid; Piwi. In some cases, a polypeptide construct contains a DEDX domain. In some cases, a polypeptide construct is absent a DEDX domain. In some cases, a polypeptide construct is adjacent to a helicase in a natural setting. In some cases, a polypeptide construct comprises the sequence of SEQ ID NO: 190, a modified version thereof, a portion thereof, or a functional fragment thereof. In some cases, a polypeptide construct comprises a genetically similar, phylogenetically similar, or functionally similar Argonaute or helicase sequence as those in Table 18 (SEQ ID NO: 161-SEQ ID NO: 252). In some cases, a polypeptide construct comprises a sequence of that is from about 50%, 60%, 70%, 75%, 80%, 85%, 90%, 95%, 96%, 97%, 98%, 99%, or up to 100% identical to SEQ ID NO: 190, SEQ ID NO: 211, SEQ ID NO: 215, or SEQ ID NO: 249.

TABLE 18

Argonaute and helicase DNA sequences

| SEQ ID NO | Argonaute # | Sequence |
|---|---|---|
| 161 | 36 | ATGCCATCAGCCGAGAGGTGCATCTGGGAGTGGAAGAGGGAAATCTTCATCACTAAAAACCCCTTGCTCAGG<br>GAAACCGTCGGCGAGCTGTCCCTCCAGGGCACGAAGGACCGAATCCAAAAATGGCTCGATCAACGCGGCGAA<br>TACCCCGCACTGAACTCCCCAGAGGAATACTCATTTTATGCCGAGGAGTGCTACATCACCGAACAAGACAGG<br>CGGAGCTTTTTTCAGCAGTACGTAGAGGTCGCCAAGCCGCACATAGGTTTATAGATTGTTGCCCCTGCTGGCA<br>CAGACCAAGATCATAAAAACTGTATGGACGACTAACTTTGACGGGCTTGTCGCCAGGGCCTGTCATTCCAAC<br>GACGTGGTGTGCATCGAAGTCGGTCTCGACAATACCCAACGCATTACGCGCCAGCATTCTGAGGGGGAGCTG<br>CGGGTTGTAAGTCTCCACGGCGACTACCGATACGATGAGCTTAAGAATACAGATGAGCAGCTCAGGTACCAG<br>GAGGAGGCGCTTAAAAACAATATAGAGCACGAGCTGCAGGACTACGACCTGGTAGTGATCGGTTACTCCGGC<br>AGGGACCGGAGCCTCATGAACGTACTCGAAAACATATTCAGCAAGGCCGTGAAGAGCAGGTTGTTTTGGTGT<br>GGCTACGGCGAAACGATAAGCCAGCCCGTTATGGAGTTGTTGGAGCTGGCCCGCAAGAATAATCGAGACGCA<br>TTCTATGTCAGCACCGAAGGCTTCGACGACACCGTTGAAAGAATCAGTAGGAAGCTGCTTGACGGCAACATG<br>CTGTCCAAAGCCTTGGCTGAGATACAGGAGACCACTTGCATCACCAACCAATCTGCCAAATTCACCGCACCT<br>GAAAACGACATCAGCAGCCTTATTAAGTCAAACGCATACCCCCTCCTGAAGCTCCCGTCTCAGTTCCTTAAA<br>GTGACCCTCAAATACCCGGAGGGGTCCTTTAGTTACATTGATTGGCTTAACTCCAAGGTTGACTTCAAGGAG<br>GTTGTGTTGTCTAAGATAGACAAGGAGATCATCGCGTTCGCGGATGTTGATAAGCTGAGGAAGTATCTGGGC<br>GAGTTCTACCTGTCTACGCCCACGGTGGTGAACTTTAGCAAAACGGACGTGCTTAACGATACTCGCATTCAG<br>AGTCTGGTGAGGCGCGGACTTATACAGTCCATCGTAAAAAACCTGAACCTGCTCCAGCGACCAGAACAAGCGA<br>ATATGGAATCCAGACGTGAGCTCCATCGAATTCTACAACGGCAAGAAGTACAAAATCATCGACGCGCTCATC<br>CTCAATCTTAGTTTTATCAAAGATGACATCTACCTCACGTTCAAACCCGATCTGCTGGTCCTTAACCTCGAC<br>GAGAGCCTGCCAGACAACGATATAGTTAAGACTATCAAGAACAAAAAGTTCGGCTACCAGCACAACAAAGAG<br>TACAGTCAGATCCTGGAGAAGTGGGCCAACCTTATAACGAAGAAGGATTTGGTCGTGAGTGGCGGGAGCGTG<br>TTCTTCCTTGGGAAGAAACCGCTGTATGCCGGACTTGTGTCTTACGCCGCGAGGAAACTCCCAACAGATTAT<br>AACAAGCACGCCACCCAGAAAGGACTGATCATTCAAGACGCGAAACTGATTTTTTGCAGCAATTCCATCTCC<br>AATGAGATTTCTCACATCAACCCCCTGAAGGGGCTCGTGGAAAATCGCCCGTGGGACTACAAAAACACCAGC<br>TCTGGGCTGTGCCCCGAGATCTGCATTAACGTGATCTCAACCAGGCAGGACGCGGGTGTGGTGAGCAACCTT<br>CTCCGAGGTATTCACGAGAAGTCCTTCCCGGAAAAATCCGAGCAAGATTACTTGCACCCCTTCCATGGGTTC<br>ACAAACGCTTTCGGGGTGCCCATCACGATCCCTAAGATCGGTGAGAATACGTGGCGCTTTGTGGACGAAGCA<br>CTGAGTGCACAGAAGGCCATCGATAACGCGAAGAACCTCGCGAACCGCATTTGCTATGAACTTGACAGCCTG<br>AAGAAGCTTGAACTGCCGACGGGCACCGTCGTGATCATATACATCCCCAAGAGATGGGAAGCATTGACATCC<br>ATCAAGTCTGAGCATGAGTACTTCGACCTGCATGATTACATCAAGGCCTATGCTGCGCAACAGGGCATTAGT<br>ACGCAATTCGTGCGCGAGAAAACGGTTAATTCAAGCCAAAGCTGCCGGGTAAAATGGTGGCTCAGCCTGGCG<br>TTCTACGTGAAGGCTATGCGCACTCCGTGGCGGTTGGAGAGTATTGATAACCAAACGGCTTCGTGGGGATA<br>GGGTACAGCATCAATCGCAATATGCATCCCGAGAATTCCAAGCGGATAATTCTTGGATGCTCCCACATATAC<br>TCCGCCCGAGGCGAAGGCATGCAGTTTCAACTTGGGCGAATTGAAAATCCCATTATCCACCATCACAATCCC<br>TACATGAGCGAGGAGGACGCTAGACGCACCGGCGAGAAGATACGACAAATGTTTTTTGATGCCAAGATGCAA |

TABLE 18-continued

Argonaute and helicase DNA sequences

| SEQ ID NO | Argonaute # | Sequence |
|---|---|---|
| | | CTGCCACGCAGGGTCGTCATCCACAAGAGGACCGCTTTCACTGAAGAGGAACAGCGGGGGTTCATACAAGGA<br>TTGGAAGGCGTTGAGGACATCGAGCTGATCGAAATTAACTTCGAGGACTCCCTCCGCTATTTGTCTAGTAAG<br>TTTGTAAACAGCAAGCTGGAAATCGACGGGTTCCCCATCGCTCGGGGGACCGTAATCGTGCAAAGCAGCAAC<br>ACCGCGCTCCTGTGGGTGCATGGTGCAACCCCTAGCGCGCAAAATCCAACGTTTAAGTATTTCCAAGGCAAA<br>CGACGGATCCCCGTGCCCCTTGTCATAAAGCGCTACGTGGGGCAGAGCGACATTAGCCAGTTGGCGAACGAA<br>ATATTGGGCCTCAGCAAAATGAACTGGAACACCTTTGACTATTACTCCAGGCTTCCTGTAACCCTTGAGAGC<br>GCCAATGATATTGCCCGGATCGGCGTGTATTTCAACAATTTCTCCCCCATGAGCTACGACTATCGGCTCCTC<br>ATA |
| 162 | 90 | ATGATCAAACACCTCAAGTTCGACGAGTTCCTTCGCAGCGTGTCAATTAGTAAGGATAACACGTACTCCATG<br>CTTATCGGTGCCGGGTGCTCAATCACTAGTGATATCCAATCTGCCTATGACTGCATATGGGAATGGAAGAAA<br>ATAATTTACAAGTCCAATAACTTGAATACTCAGGACTGGATAGAGAATTACAAATCCCCCAAAACACAAGAC<br>GTGATACAAAAATGGCTTGACAACCAGGGAAACAACCCTGAGAAAGATAATATCGAAGAGTACTCATTCTAC<br>GCAAAGAAATGCTTTCCGATAGATGAAAATAGACGCCAGTACTTCCAAAAAATCTGCGCTAATAAGAAGCCC<br>AGCGTCGGATATCGAGCCATTCCTCTCCTGGTGAAGCAAGGCATGCTCGACTCAATTTGGACAACCAATTTT<br>GATGATCTTGTTAATGTGGCGTGTATAGGTGGTGGCGTTCAGGGGATTGACATATCCCTTCAGACGGTAAAC<br>CGCATAAATCAACGCAATCAAAGCAAAAATGAACTGCCTATTATAAAGCTCCACGGGGATTTCAAGTATGGC<br>GACCTTAAGGACACGAGTGAGGAACTTCAGAATCAAGACGAAACGCTTAGATCAAAACTTTTGGACTACTTG<br>AGCGATAAGAATCTCATAGTCATTGGCTATAGTGGTCGGGACAACTCACTCATGGAGAGCTTGAAAGAGACT<br>TATTCAAAACCTGGTGCGGGAATATTGTTTTGGTGTGGGTATGGGAACAGTCCATCAAACCAAGTGAAGGAA<br>CTCCTTAAATTTATCAAGGATAAGGGGCGCAGCGCATTCTATGTTTCCACTGAGGGATTCGATAACACCATG<br>CTGAACCTGACCAAGCATGTTATTGAGGACGATGATAACCTCAAAGAGGAATTCAGAGAACTCAAGAAGAGT<br>ATCATTAATAAAAATACAACGACCCCGTTTACGTTGAACCCGGAACGAATCAATAAGGTACTGAAAAGTAAC<br>CTCTTTCCTATTACATTCCCCAAAGAGATCTTCGTATTCAATGCGACCTTCGATAAGAAACCTTGGGAGCTT<br>GTTAAGGAAAAAACTCTGAGTGACTATGAAATTTCAGCGATTCCATTTGAAAAAGACATATGGGCATTTGGG<br>ACTGCTAATAACGTCTACGAAAAGTTTGCAGATATCATTAAGGGCGAGATCAACGGAAGCCCCTGACCGAT<br>ATCCGGCTTTATAATCACAACATAAAGTTCCTGCTCCTGTCAAGCCTCTGCAAGCTGTTCTCAAAAACCTAC<br>AATCTGAAAACGGACTTTCGGTCTAAGATTTGGGATGAGAGCTCATACAAAACGGTTCACAACCAAAAGGTC<br>TATAACGCTATAAAGATCGATCTCGTCAAAATACAAGAACAGTCATATTTGTCACTCAATCCAGACTTTCAA<br>TTGGCAGATGATAACGTTCCCAATGATATCAACCAGCAGGTTGGACTGGAATTTTTTCATAAGATCTATAAC<br>GACAAATTTAACGACTATATAAACATCTGGAGAAAGAAGATCCTCGAAACTACGTCATACGAATTGCCACTG<br>AACTCCGGCACCGGGTTCGTATTTAAAATCTCTAAGAATCCAATTTTCACAAATATAGATGACCTTAATTCC<br>AACTATACGAACGAGCACAATATACCCATAAACATGATTAAACTTAAGGGGGTTCAATTCAAAGAGACGAAC<br>CTCCTCTTTAGTTCACAAAATGGAGATAAAGTGGTTAAGGAGACCCACCCAATGAGAGGCCTCGTCAATCAT<br>AGCCCGTTCGATAAGGGATTGAGTAGTCTTAAAAACACTACGATCAACCTGGGGATCGTATGCCCCCAACAG<br>GATAGCGAAAATTTTTATACTTTTTTGAATAAACAAAACCAAGAGATTAAGAACGTTAATATTAAGGATCAA<br>TATGTAATCGATTACAAAGGATTTCACAACACATACGGTTTGAGTCTGAACATACCTACTACGAGCAGTCCT<br>AATTGGGAAATGACTAACGAGCCTGTCTCAAGGGACTCAAAGAAAATAATTCATGAAATCAAGAATAATATT<br>TGCGACAAGATAAATAAGCTTTGTAGTATAGGCGGACAGAAGCAATAGTAATATTTATCCCTAAACGCTGG<br>GACAACTTCGTACACTATAATGATGCCGTGGAAAGCTTTGATCTTCACGATTATATCAAAGCGTTCTGTACC<br>GAAAAAAAGGTTACGTCTCAGTTGATACGGGAAAAGACGATACTCGATAATAACCTCGAGTGCCAGATCAAC<br>TGGTGGTTGTCACTCAGTTATTTTGTAAAGTCCTTCCGAACACCGTGGGTAATCGACAACACCGACAATAAA<br>ACAGCTTTTGCGGGCATTGGTTATTCAGTAGAGTCCAAAAAAGAGGATAAGGGGCACATTATACTTGGCTGT<br>TCCCATATTTACAGTAGTAACGGGGAGGGTCTCAAGTATAAGCTTTCCAAGGTTAATGATAAAATAGAATGG<br>ATCAAGAAAAAGCCGCATCTGTCCTACGACGATGCTTACGAATTTGGTAAAAATGTGATCAACCTGTTTTAC<br>GAAAGCATGAATGAGGTGCCAAAACGAGTGGTAATTCACAAACGCACCTTTTACACTGAAGATGAGAAGCAA<br>GGCATACTTGACTCTTTGCACGATAACAAGAAAATAGAAACATAGACTTGATAGAAATAAATTTCGAAGAC<br>AACATAAGGTACGTCTCCTCTAAGATATATAATCGGGAGGCAAAAATCGACGGTTACTCAGTATCACGCGGT<br>ACCTGTATCCTTCTTAACGAAAAAGAGGCACTTTTGTACGCCCATGGCGTAATCCCGAGCGTGAAGAATCCG<br>AGTTATAATTTTTATCCGGGAGGAAGGTACATACCGAAGCCATTGAGGATAATAAAGCATTATGGAGTTGGT<br>TCCCTGGAACAAATAGCAAATGAAATACTGGGTCTCACTAAGATGAACTGGAACTCTCTGAACATGTATAGC<br>CAAATGCCTGCCACGATCGACTCAAGTAATAAGATAGCCAAAATAGGGAAACTCATAGAGAATAGGGATAAA<br>GTAGAGTACGATTATCGGTATTTTATC |
| 163 | 18 | ATGAGCGAGCTGGAGACCAACATCTTCCCAATCACCAACTTGCATGAGCTTGAAAGCAGGTTCAGGTTGTAT<br>AGGGTGAGGGGCCTGAGCATCAACCAAGAGGAGTACGACCCCAACACCCAGACATTGGTGAGGAAGCTGAGC<br>TACAGCATGAGGTCTCCCGTAGCTGTGATACTTAGGAACAGCGACCCGTTCCTGGCTCTTCCAATCGACGCA<br>CCCGACCCCATCTCTCCGTACCCGCTCGTGACGAGCCACTGCTGTGTTCGAGAAGACGGACGAGGTATTTACT<br>CTCGATTACGAAAGCCCAACTCCCGAGACAGATGCGCTGCGAATAAGGTTCCTGCAATTTATCATCCAAGGC<br>GCGCTGTTTAGGAATCCCAGCCTGTGGCAGCCCTCAGCTGGCACCCCCTTCTTCGAGAGGGAGCCCCGTGTTG<br>GAGAAGGCCGGCATTTGCGCGTACCGAGGCTTCTCAGTGCGAGTCGTGCCCATAGAAGGTGGTAAACTGGGA<br>ATCTGTGTGGACGTTTAGCACAGGTACGTCAGCAAAAACCCCATCGAAGCAAACATCAAGCGCGAGGAATTC<br>AGGAAATACAAGAACGGCAGGTGCATATACCACTACGGCCACAACTGGTACGAGATCAAGTTGCAAGACCAC<br>ACTGGGCTGTCCGTGTCAGAGCAGATGATCAGCAACGGGACGGCCAAACCCATAAGCTTGTATCAGTTCATT<br>ATGAATAACGCGCCCAAGCCCCTGCCCAGGGAGGTCATAGACATGCCTCCCGACTCACCCGCAGTCAAATAC<br>ATGACCAGCAGGGATGAGGTGCGCTACGTGCCCTCCATCCTTTGTTATCCGGTCTTTGACACCTCTGACCCC<br>AGGGTGAAGCCGACGCATAGGGGCACAATCCTCCTCCCTAACGTGAGGCGACAGTATATCCACAATTTCGTG<br>AACTCACACCTGACCGATGTGCGATCAAAGACATGGCAATCCGAATCAGCAGCAAGCCAGTTATCGCCCCT<br>ACCAAGATTTTCCTGCCGCCTGACCTGGCATTCGGCAACAACACCGTGTTCAGCGTAAGAGGCACACCCGGG<br>ACCACGTATGTTAGCCTGGAGCAGCTGGGCCAGACGGCGGATAAGCGCCCTCTTCAATCAGAAAATAGGCCCT<br>TATGACAGCAGGCCGCTGGATAGGCAGTACATGATTCTGCCGAAAACGCGTGTGGGACTCCCACGGGCCAGTA<br>TTTCTGAATGACTTTAAGAAAATCATGAACGAGCTGTACCTGCACGAACTGCCCTACAATCCCATCGTCGTG<br>ACCTACAACGACTTGAGCGCCAAGACCTACGCGCTTCAGGGAAGGGCTATTCTGGACGCCGTGGACAGCGAA<br>CTGAGAGAGCCGGGATACGGCGTGGTTATGATACACGAGACGGTGGACCGCCGGAATAGACAGCACGACCAG<br>CTTGCCGCGATGGTGATGAGGGGAGCTGCGGAACAGGAGGCTGTATGTGAGCGTGATCCATACCACGGTGACG |

TABLE 18-continued

Argonaute and helicase DNA sequences

| SEQ ID NO | Argonaute # | Sequence |
|---|---|---|
| | | AAGGACTGTTACCAATTGCCCCAGAACGCCCCCATTGGCAAGGCCTACTGCCCGGTAGCAGGCAAGCAGGGC<br>AAACTCAATGGCTACTTGAGGAACGTGGCCATTACCAAGGTGCTTCTGACCAACGAGAGGTGGCCCTTCGTT<br>ATATCTACCCCGCTGCATGCGGACTTTACCGTTGCCTTCGACGTGCAGCTTAACACCGCTTGCTTCACATTC<br>ATCGGCAAGAGCGGCTCCGACATCCGGACCGTTTTGAAGACCAGTAACCAAAAGGAGAGGTTGAGCAAGGCA<br>CAAGTAAGGCAGACGCTCCTGGAAGTGCTCCGCCAGGAGGTTGGCTTCGGTCGACGGACCATGCAGACCATA<br>GTGGTTCAGAGGGATGGCAAATTGTTTGCCAGTGAGATCGCGGGAGCAAAAGACGCTATAGAGATAGTGAAG<br>AAAGAAGGCATCTTGCCCAGCGATGTGTCACTGAATTTCATCGAAATCCCCAAGAGCAGCGTCGCCCCATTT<br>AGGCTGTTCGATAGCAGCCCCAGGCCAGGGCAGCCTGAAATGGCGAACAACCCAAGAATCGGCTCCTACTTC<br>ATCGCGACGAATTACGACGGTTACATTTGCACCACCGGCAAGGAGTTTTACCATCCCGGTACGGCAAATCCT<br>CTCCACGTGAAGTACATCGAGGGAAATATGCCATTTGAGAAGATCCTGGAGGACGTGTACGCCTTGACTTGC<br>TTGGCGTTGACCAGGCCCGAAGACTGCACAAGGGAACCCTTCACCATGAAACTGGCCGATATCCGACTGAGG<br>GAACATGCCGGAGGCTACGACGAAGATGCATTGGCGTATGATGATGAAAATGAGAACGACGAGGATAACGAG<br>AATGAA |
| 164 | 57 | ATGACCGAGGCCTTCCTCACAACCAGGAGGGGCTTCGTGCAAAAGCTGACGCTGACCAGGTACGATTACCTG<br>AACTGGATCATCGAGTCCGAGGCGCAGAAAGCCAAGCTGAAGAACTGGCTTAAGAACAAGAGCGGGTTTCTG<br>ACCCACGAGATCGAGGATACCTGTTTCTTCACCTTCGAGAGGCTTCTGGAGGAGAGTACTAAGCAGTATAGA<br>GCCTCCGGCGAGAAAACTCTGTCTGCCCCGTTCAAGAACACGCAACTGATCTCAAATCTGATCGGTACCATA<br>TTGAAAAAGGAGTTGAGCAAGAAATACAAGCAATTCTTTAGTCAAAACATCTTCATCGTGAGCACCATCGAT<br>CTGTATCCATTCAATCTCTTGAAGGCGTTCGAGTTCAACATCGAAGTGTTTGACAGCGGCCACTTCCTTATC<br>CACGTCAACCCAGTGTCTAAAATTGTAAGCAGCAAGGTTGTGGACAAGGAGTATCTGGACTACCTCAAGAAA<br>AGCAACCTCAACAACAGCAAAACCACCGAGATGGAGTTCGCGGTGATCAACCATGAAAGGAATTTCAGACTT<br>AAATTCGACCTGCTTGACGAATGCATCTTTGAGAAGATAGAGAAGCTGCACAGCGAGAAGAATATGTTTACA<br>GCCACTTTTGATTACCATTTCCTGGCCAACTTCAGCCCCGAGACTTTCGGCAAAATCGTGGAACATACTAGC<br>AAGGATCTGAAGCAGGCCATCATGTTCCTGAATGACATACTGAGCAATATCAAGCTGCCGAGCTTTCTCAAC<br>CTGCACGAGGAACGATACTTTAAGGTCAATATCTCCGAATTGGACCGAAAGAATAATCTTCTGATTGGAAGC<br>AGTTTCGAGGTAATAACCATATACTCAAAAAGCCAGACCCAGTATGGACTGAGGATTGAGTTCACTCGCGAC<br>AGCATAAGCCGGGACGAGCTTATAACAATCTTTCTGAAAAACGAAGAGCTGATCGAGAAACTCAACGACATT<br>AAAGTGGTCCCCGCCACCATCAACGCAAAAATCGAACAGAAGACCGGCTGGAAAAACCCCTACATCACCAAT<br>GTTTTCATCGATAACGTGGGTGCCTTCAGCACCAGCAGCCTGCAAAGCGCCTCATACTTCCACGGCATCTAC<br>AAGGCCGTTAACAACTGGAATATCCTGCCCATCGTGTACGAGGACCTCGACATCAAAGTATTCGAGAACCTG<br>ATGCTGCACGCCTTTAACAAGAACGCCACCGAATTCAAGATCCTGGAACCCATCATAATCAAGTCCACGAAC<br>GAAATCGACAAACAGGAGGTGCAGAGGAGCATCAAAAAACCAGGCCGGCAAGACCATGATCGCAGTGTTCTGC<br>AAGTACAAGATACCCCATGACAGCTTCGCCCCCCTCAAGGGCTTCAAGTATCAGATCTATCAAGGCGACACC<br>ACGGACAATAAGCAGAATAGGGCCAAACTGAGTAACTTCACGTGCAAGTGCCTGGAGAAAATGGGAGGGGTG<br>ATTGCGGCAATCGCGGACACAAGCATAGCCGAGGATGGATATTTCATTGGCATCGACCTTGGCCACACCACA<br>AATGGCAAGGAAAAGTTCTCAACCTCGGAGTGAGCTTGTTTGATAGCCTGGGCATCCTGTTGGGCGATTAC<br>GTGGAGAAGGAGATTCCAAGAAGGGAAAACCTCATCGACACGAACTGCCTCAATGCTTTTAAGAAACTTGAC<br>AAAAATGCTGGAAGCTAAAAACTGAACAAGCCCAAACACCTGATCATCCATCGGGACGGCAAACTGCACTTC<br>AAGGATATCAACATTCTCGTAAGCTGCGTGGAAACCGTGTGGGGTAAGATAAACGTCGATATAGTCGAGATC<br>ATTAAGAGTGGCTTCCCCGTGATGGCTATAAAGGACGAGACCAACAAACCAATCAATCCCATAAGCGGGACC<br>AGCTACCAGGACGACATCCATAAGTACGCCATACTCGCCACAAACGTACAAGCCGACGAACAGTCAGCCGTA<br>ATAAACCCGATAATCATAAAACACAAATACGGAGAGCTGGAGTTTAGCAAAATAGTTGAACAGGTGTACTGG<br>TTCACGAAAGTGTATACCAATAACCTGTACAATAGTACCAGGCTCCCAGCGACTACACTCAAGGCCAACAAC<br>GTGGTTGGCACGTCTAAGAAGCTCCACAGAAGTACATACTTGGGC |
| 165 | 59 | ATGTTCGTGGAACTGAACGCCTTCCCCATCGACATCCGCAATATCGGTATCGTGGAGGCCTGCGAGGTGCCG<br>TACGACAAGGAGGTGCTTTATAGCCTGCATGATAACCCACAAAAAGATTACCATGCTATCAGAAACGGCAAC<br>CAGATATTGATATTTCTAATAGCAAAAACTACCCCATCCAGGGTACAATCAAGGAGATAAATCTTGCACAG<br>GACTACCGCATCCGTGTTTTCCTTATTAAGGAGTCCATTATCAAGATCCTGACGCAGATCAAACGGGAGCCT<br>TTCAAGTTCAACCCGATTGAGTTCATCTCACCAAAGGAGAACATCACCGAGAATATCCTGGGAATCAATTAC<br>CCATTTCAAATAAACGCCAAATATTCAATCGATACCAGAATCATTCAGGGGGTGCCCTGCCTCACCATTGAT<br>TGCAGCACGAAGAAATACAACAAGGAATCCCTGATCTACTTCATTAACGACGGCTTCAACCTGATTAACAGG<br>TACGTGATCTCAAAGCAAAACGAGAAGTATAAGCGCGTAGGTAAGATACTGAGCATTGACAACAACATCGTG<br>ACTGTTCAGAGCTGCGACAAGATAAAGAAGTACTCCGCCGAGGAAATCACCTTGGAGGCGAACTCTAAGAAC<br>ACCAAGGACTATCTGGCATACAAGTTCCCCTATAAGTTCGAGCAGATCCAAGAAAGCATTAAGAAGGCGATC<br>AGTACCTTCACCCAGGGGACCTCTAAGCAGATAAACATTGGCAAGATCTGGGACTTTTTCAGCCAGAAAGGC<br>ATCTTCCTGTTCAACGGCCACCGAATTAACATAGGGCTGCCTCCCGACATCTCCCAGCAATGCAAGAACCTT<br>GTGTACCCGCGCTTTTTCTTTAGCAACTCCCGAGAAAACAATTCCAAAGAGAACGGCCTGAAGGATTATGGC<br>CCTTACACCAGGAATTACTTTGACAGGAATAACCCCAGCATTTGCGTGATTTGCAACGCTAAGGAACAAGGC<br>AAAGTGGAACAGTTCCTGCACAAATTTCTGAAGGGCATACCCAATAGCCATAACTTTAAGACGGGCTTCGAG<br>GGCAAGTTTCATATTGGCCTCTCTCAGATAGAATTTTTCACGACCGACGACGACCGCCTGGGCAGCTACCAG<br>TTGGCTATCCAGAAGGCAATCCAAACGAGGACTAACCAAAACTCTAGCCAGTGGGACCTGGCCCTGGTGCAA<br>ACCAGGCAGTCCTTCAAGAAATTGTTGGTGGAGCAGAATCCGTACTTTATTAGCAAGAAAATGTTCTTTCAG<br>CATCAGATCCCCGTTCAAGACTTCACCATCGAGCTGACCAATCAGAACGACAAAAACCTGGAGTATTCTCTG<br>AATAACATGGCTCTGGCGTGCTATGCGAAGATGAATAAACATTGGCGAGATCTGGCTGCTTAAATCAAGCCCTACTATC<br>AGTCATGAGCTGGTTATTGGCATCGGGAGCAGCAACATCATCGAGGAGGACAGTCTGAACCAGAGGATC<br>ATGGGCATCACCACCGTGTTCAGCGGCGACGGGTCTTACATGGTCTCAAACACTAGCAAGGCGGTGGCGCCC<br>AATGAGTACTGTTGCGCCCTCATAGACACACTTGAGCAAACGATCAAGAAGCTGGAGAAACTTATGAACTGG<br>CAGAGCAATGACACCATTAGGCTCATCTTTCATGCCGCCGTGAAGACCTTCAACAAAATGAAATCCTCGCC<br>GTAAAGGAAGTGATCAAAAAGTATAGTGAGTACAAGATCGAGTACGCTTTTCTCAAAATCAGCAGCGACCAC<br>GGTCTGCACCTGTTCGACCACTCAACTAAGAATGAGAATAAGGGTAAATTGGCTCCCAAGAGGGGTAAGTAT<br>TTTGAACTGAGTAGCCATGAAATTTTGCTGTACCTCGTGGGGCAGAAAGAGCTGAAGCAGGTGAGCGATGGC<br>CACCCCCAGGGCGTGATCGTGTCCCTGCATAAGGACAGCAGCTTTCAGGACCTTAAGTACCTCTCTAATCAG<br>ATTTTCAGTTTTAGCTCCCACAGTTGGAGGAGCTACTTTCCCTCTCCCCTGCCCGTGACAATTCATTATAGC |

TABLE 18-continued

Argonaute and helicase DNA sequences

| SEQ ID NO | Argonaute # | Sequence |
|---|---|---|
| | | GATCTCATCGCGGAGAACCTGGGCTGGCTTAACAAGCTGAGCGGCTGGGACGATACAATCCTGCTGGGCAAA<br>CTTGGACAGACCCAGTGGTTTCTG |
| 166 | 73 | GTAAAGCTTAATCACTTCCCCCTGAATCCCGCTCTTGCAGTGTTCAAGACTACCTACAGGCACAGAAACCCC<br>AGGGGCTTCCTGGGATTCGTTAGGTCACAAGGGTTGACCGCGGAGAGAGTTGGCGAGGAAGTGTGTGTCTAT<br>CACGGTCTTCCCCACCCGGCTTTTAGAGGAGCCACCGCCCAAGGACACACCAGACTGGCGCCTGGTGACACC<br>GATTACGACAGGGGCGTACTTAGTCTGATCGGAGCCGCCCTGCTGAAAGCGGGTTACGTGCTTACTGAGCGC<br>GAAAGGGCCGCAGTGCACCCCACGCAGCAGAGAGTGCCCCTGCACACCCCTAGGAAACTCCCTGCCGAAATT<br>GCGGTGAATGCCCATCTTCGATGGGAATGGGAACTGGAACGGCACAGCGGGAAGTCTTGGCTTGTGCTTAGG<br>CCCGGACGCATGTTTTTGAGTGCGCTGAGCTGGCACGATTTGGACCTGAGGGCATGGGCACAGGAGTTGCCC<br>CAGAGCGTACAGCAACTGCACGCGCTGTGTCTTCGCTCCGGACGACGAGAACGACTGAGGCGCATGGGTAAC<br>ACGTGGGCGTTCCAACGAGAGGATAGGGAGCAAGAGGGCAGGTGGCACCTGAGCTTTAGCACTAAGGCGCTT<br>TCCGACCTGAACCTGTCCGGCGATGCTCACCATGCTGCTAGCCTGAGCATGCCCGATGTGCAGAGGCTCGTA<br>AATCTGCCGGGTCTGTGGCAGCCCTTTGTGACAAGCCTTGAAGTCCTTGAGGTGCCTGGTAAGGTGATCGAG<br>GGCAAAAGGCTGAGGTTCGGACGAGGAACAGGGCGCGACGTCACGGATGTACACAAAAGGGGCATCCTTCAC<br>CCTCCGCCGCAGCCAGTGCGCCTTGCGGTCGTGCCCCCCATTCAGGCGGACGAAGAGGCGGATGAGCAGTTG<br>AGACGCGAGCTCCTTGCCCACCTCCTGCCACGGGAAAAGGTGTTGGCCCACCCCGAGGCTTCCCAGGGCCTC<br>AAGAAGCACTTGAATCGAAGGGAAACCGACGACACCTTCTACACCCTGTGGAGCGCTGGAGACTACTGCAAA<br>CTGGGGCTGGAACCCTTTGATCTGGTGCGCGACCTCCATAGGTACGACCCCGGCACGGGTCGCCTGCTGGCT<br>CCAGAGAAGTTGCATGGAGCAGCAGCCGCCGCGAGAGAGGCTGGCAGGCAATTGATTGGCCTCGTGATCCTG<br>CCCGACACCATAGGGCGAGATGAGAGGGACGCACTGTCCGACGAACTGGCCAAGCTGGGTGTGAAGAAACTT<br>CAGCACATCCGCAGGGACATGCTGAACCGGCCCAGGACGCAGTATATGGCCTGGGTGAACGTGGCCGTGAAG<br>CTCGCCCAGAGGGCCGGAGCAGTCAGCTGGGACCTGGAAAAGTTGCCTGGAGTGTGCGAACAGACCTTCTTC<br>GTTGGCGTGGATCTGGGCCATGACCATCGGGAGAAGCAAAGCGTCCCGGCCTTCAGCCTGCACGAGTTCCGA<br>GGCAGGCCGGTCGACTGCCTCACCCTTCCAAGGCGAGCCGGAAATGAAAGGTTGAGCCTGGCGGAGCTGAAT<br>CAAGGCCTGAGGAAGCTGCTTAAGGGTAAGAGGCCAGCCCAAGTGATAGTGCATAGGGACGGCAAGTACCTG<br>GAGGGGGAGGTTGATGACTTCATAATCGCTTTGAACGACCTCGGCGTGCCGCGCGTCAGTCTTCTCGCCGTC<br>AAAAAGTCCAACCTCTCCATGGTTGCCGGCGCTAAGGAGGGAGCGTTTTTGCCACTGGACGAGCGGCGGTGT<br>CTGCTGGTTACCAATACCCAAGCCGCGGTAGCTAGGCCGACAGAGCTGGAGGTGATGCACTCAGATCATCTG<br>ACTTTCGCCGAGCTGACCGAGCAAGTGTTCTGGCTGACCCGAGTATTCATGAACAACGCACAGCATGCGGGT<br>AGCGACCCTGCTACCGTAGAGTGGGCGAACGGGATCGCTAGGACCGGAAAGAGAATTGCCCTGTCTGGGTGG<br>TCCGCC |
| 167 | 72<br>(Helicase) | ATGCTCGACTTTAGCCTTACCCAGAAAGGTTGGGTGCTGCCCATCGTACTGAACGCCTTTCCGCTCAAGGTA<br>CCGGACATGGAGCTCAAATTCGTGCAGATCCCCTACGACAAGACGACCCTGGACTCACTGAGGTCAAGCCAC<br>AAGATGACCCACGTCTTCAGGAGGCAAGGCGACAGTATCCAGATCTTTTCTAGCGACGGCACCTTTCCAAAG<br>AGCCGGCACCCCCCAGACCCTCCAACTGAAGGATAATCTGGGAATCTTTTTTCTCTTTGTAAAGGACGGCCTC<br>CTCAAGCACTTCGCCGGTTTGGGCCGAACCCCGTGCGGATTCAACCCCATTGAGGTCGTGTCAGCTCAGGCC<br>AAAGACAATCTTCTGGCTAGCATCCTCGGAGAAGCCTACCCGCTGAAAATTTGCGCCAAGTACTCCATCGAC<br>ACCAGGACAGTGCAAGGTCAACCGTGTCTCATCATCGACTGCAGCACTAGGAGAGTGGTTAAAGAGAACTGC<br>CTCTTCTTCTTAAGACCGGCTTTAACGTGATTGGCCGCTATGTAGTGACCGAGCAGGACGACGGGTTTCGG<br>AAGCTGCTGGGTTTTGTGGAAAACTGCCACGAAGGCAGGACACTGAGCGTTATAAGGCCAGATGGCCAAGCC<br>GTGCATGCCGAGGCCAAGGACGTGTATCTCGAGGCATCTAGGGCCAACTTCGACGACTACATCCTTTATACG<br>CACGGAACTAAAAAGGATAGCATCGTGGAGCGAATCAGACAAAGCGTGAGTATCTTCAACGGCGGTAAGAAC<br>AAGAAAGATAGAATCGACGCGCTCAAAAAGTACATCCAGGCCACCAATATAAGCCTTTTGGATGGGACCAGG<br>ATCGAAATCGAGGAGCCCAGCGACATTCAGAAGGACTGCGCCCAGATGCAGAAGCCCGTGTTTGTGTTCAAT<br>GACAATGGCGAGGCCGACTGGACCGAGAAGGGGCTGACTCAGAACGGCCCCTACACCAAGCGCACCTTCGAC<br>CGAAACGACCCCAGCATCTGCGTGATCTGCGCACAACACGACAGGGGGCGAGTGGAGCAGTTCGTTAGGAAA<br>CTGCTGAAAGCATGGCTAACAGCAAATACTTCAGAAACGGCCTTGAAGGCAAGTTCGCGCTGGGAACGTCC<br>CGGGTAGAGGTGTTTGAGACCAGCACAAATAGCGTGGACGCCTATAAGAGCGCGATCGAAGCCGCATCCGC<br>AAGAAGGCCGATGACGGCGGCAGGTGGGACCTGGCATTGGTTCAAGTTAGGCAGAGCTTCAAGCAGCTGAAG<br>GTGACTGACAACCCCTACTACTTGGGAAAAAGCCTGTTCTACATGCACCAGGTGCCAGTGCAGGATTTCACT<br>ATCGAGCTCCTGAGCCAGTCCGACTATTCACTGGGCTACAGCCTTAACAACATGAGCCTCGCTTGCTACGCC<br>AAAATGGGAGGAGTGCCCTGGCTGCTCAAGTCCTCTCCCACCCTTAGCCACGAGCTGGTGATCGGCATCGGC<br>AGCGCCAACATTGTCCAGGAGAGGGGGGCACACAACCAGAGGATCATGGGGATAACCACCGTATTTAGTGGC<br>GATGGCAGCTACATCGTCAGCAGCACGTCCAAAGCTGTGGTTCCCGAAGCATACTGCGAGGCGCTGACTAGC<br>GTGCTGGGCGAGAATATCGAAAAAATCCAAAGGAGAATGAATTGGCAAAAGGGTGACTCAATCCGACTGATC<br>TTCCACGCCCAAGTGAAGAAGTTCAACAAGGAGGAGATTCAGGCAGTGCGAGCCGTGATAGACAAGTATAGG<br>GACTACCAGATCGAGTACGCTTTTGTGAAAATCAGCGAGAACCACGGCCTGCACATGTTTGACAGCTCAACC<br>GCCACCATGCCCAAGGGCAGGTTGGCCACACACAGGGTAAGACCTTTAAGCTGTCCAAAAACGAGATGTTG<br>GTCTACCTGATCGGACAGAGGGAGCTGAGACAGGAAACCGACGGCCACCCCAGGGGTGTCATCGTGAACGTA<br>CACAAGGACAGCACTTTCAAAGATATCAAGTACCTGAGCGCCCAACTGTACTCTTTTGCGAGTCATTCTTGG<br>AGGTCATACTTCCCCAACCCTATGCCCGTGACCATCACCTACAGCGACCTTATCGCCCACAACCTCGGCTGG<br>CTGAACCAGCTGCCCGGGTGGTCTGACAGCGTAATGATAGGTAAAATCGGTCATAGCCAGTGGTTTCTG |
| 168 | 92<br>(Helicase) | ATGTTCGACATTGGATCAATGGTGAGAGTTAGGGGTCGAGACTGGGTCGTGTTGCCTGGCAGTTCCGCAGAC<br>TTTCTCCTGCTTAAGCCACTCGGCGGATCAGATGCAGAAACGACAGGGGTTTATGCCGGTCCCGGCGGCGAA<br>GTTGTGAGATCAGCGACTTTTGCGCCACCCGATCCGCAAGCGTTTGGAACAGCCTCTGGCGCTCGGCTTCTC<br>CTGAATGCAGCTAGATTGGCCGTTAGGTCCGGCGCTGGACCGTTCCGCTCCCTTGGCAGGCTGGGGGTAGAA<br>CCACGCCCATATCAACTTGTCCCCCTCCTTATGGCCCTGAGACAAAGTACCGCCCGGCTCCTTATTGCCGAC<br>GATGTAGGGTATAGGAAAGACAGTTGAAGCGGCACTCATCGCACCAGGGAGCTGCTTGACCGCGGAGAGATAGAG<br>CGATTCGCTGTGCTTTGTCCGCCCATCTGGCTGGTCAGTGGGTAGGTGAGCTGAGGAGCAAGTTTGGGATA<br>GATGCCGTCGCGGTCCTCCCCGGAACCGCGCGAAGACTGGAGCGCGGCTGTAACCCAGGCCAATCTGTGTTC<br>GCCAGATACCCTTTCGCAGTTGTCTCTCTCGACTTGGTCAAATCAGACCGATGGCGCCAGGATTTTTTGCAG<br>AACGCCCCCGAGTTTGTTATCGTCGACGAAGCGCACGCCAGTGCTGAGGGCGAGGGGTTGGGCGCGCGAAGA |

TABLE 18-continued

Argonaute and helicase DNA sequences

| SEQ ID NO | Argonaute # | Sequence |
|---|---|---|
| | | CATCAGAGATATCGCCTTTTGGAGGACCTTGCGCGAGACCCAGAGCGACACTTGATACTCGTGACAGCTACG<br>CCACACAGCGGAAAGGAGGACGCATTCAGATCCCTTTTGAGATTGCTCAACCCTGAATTCGCCGCTCTGCCA<br>CTGGATCTCTCCGGCGCTCAAAACGAAAGAGCTCGGGCAGCTATCGCTCGACACTTGGTGCAGCGGAGGAGG<br>GGTGACATCACTGCATACCTTCACGAGGACACCCCATTTCCAGTCCGAAGGGACGCCGAGGTTAAGTATACT<br>CTGCACCCCGATTATGCGGCATTGTTCGAGGACGTTCTGGCCTATGCAAGGGAGTCCGTGCACGTTCCAGGC<br>GAGGCGCATAGTCGGACGCGGATACGCTGGTGGGCCGCCCTGGGACTGCTTCGGGCTTTGGCTTCTTCACCC<br>CAAGCAGCCGCAGCCACTCTCCGGGAAAGAGCAAGCACCGAAGGCGAGACTGATGAAGCAGTTATTGAAAGA<br>CTTGGCAGGGAACTGGTGCTTGACCCCGAAGACGGTGAACATGGGCTGCTGGACGTCACCCCTGGAGCGCAG<br>GTCGACGGTGAAGAAAGCGGGACCACGCGACGCCTTCTCGCACTCGCAGAGAGGGCCGACGCTCTGGCTGGG<br>GCCAAAGACCGGAAGCTCGCACTCCTGACCGCACAGGTCAGGGATCTTCTGCAGGAAGGTTTCGCGCCGATA<br>GTTTTTTGTAGGTTCATTGCGACCGCGGAGGCAGTAGCGGAGCACTTGAGGGGAGTTCTGAAAGGAGCTGAA<br>GTCGTGGCTGTCACAGGAAGGCTGACGCCAGATGAGCGCGTCGCCCGCATCGAAGAGCTTGCACCCCACGAG<br>CGACGGGTTCTTGTGGCAACGGACTGCCTTAGTGAGGGCATTAATCTCCAAGCTGCCTTCAGCGCAGTAGTA<br>CACTATGATCTCCCCTGGAACCCTACCAGGCTCGATCAAAGGGAGGGCCGAATTGACCGATATGGTCAACGA<br>TCACCAGAGGTCCGAGTGCTTACATTGTATGGGGAGGATAACAGGATAGATACTCTGATACTGGATGTTTTG<br>ATCCGAAAGCATCGGCTGATCCGGGCTACCTTGGGAATGGGTGTCCCCGCTCCCGACGAGGCAGAAGGATTG<br>CTTGACGTGCTGTTGGCGCGAGTACTGGAACCCGAACGAAGAGGTTCTATTCAGCCATTGCTTCTGGATGAA<br>GTGCAGGCTTTTGATTTGAAATGGCGCGATGCGGCTGAAAACGAAAAAAGGTCAAGGTCACGATTCGCCCAG<br>AACTCTATAAGGCCCGAAGAAGTAGCAGGGGAACTCGCAGCGGTACGGGAAGCGCTCGGAGACGCTCGAGCC<br>GCTCAGGACTTCGTTCTTGATGCACTGCGAGGGGCCGGTGTTCAGGTGACGCCGCCGCCCGACGGAAGCTTC<br>GAAGCGGACCCCACCCAAGCCGATGTAGCACCGGAGGTCCGCGACTTTCTGCGGGGAGCAAGGCGCTTCAGA<br>TTTGACGCACGGGTAGAACGAGGTGTGACGCCCTTGGCGCGGAACCACCCATTGGTCGAGCAACTTGCAAGC<br>ACTGTACTGGGTCAGGCTCTGGAGTCTCCGCAGGAGGCCGCAGCCAAGCGCGTAGGCGTCATTCGGACCTCT<br>GGCGTAAGTACTCAGACCACTCTTTTGCTCCTTCGATGGAGATTTCATCTTTCCGGACGAAAGGGAAACCGA<br>TCTTGGCAAACTCTTGCTGAAGAACTTGATCTTCTGGCTTACGCAGGAAGGGCAGAGGATCCGCAGTGGTTG<br>GACGCTGAGGCCACCAGAGCTTTGCTCGATCTGACCCCTCAGGGTAACTTGGATCCGGTGCAGAAAGAGGAA<br>CGCCTTACTCGGACGCTTGAGGGACTTAGCGCTTTGGAGGGGGTTTTGGACCAGCGAGGAAGGGATAGAGCC<br>GCAGCTCTGCTTGACGCTCACGAGAGAGTACGGGGAGCAGCGCGAGGGCAAGGGGTGACCTATTCTGCGGAG<br>CCTCCTGGCCCCCCGGATCTGCTTGGTGTCTATCTCTTTCTCCCCGCACCAAGACTCGGAGGCCTCGCC |
| 169 | 71 | ATGATAGCCGTGGAAGAGTGGCAACCTGCGGACGGACTGACCCTTGAGCCTAATGCAAAGAGGGCTGCGAAG<br>GCTAGAAAGAGGTGCCTGGCCCTGACAGCGGGTCCCGGTGCCGGAAAGACAGAGATGCTCGCACAACGCGCC<br>GACTTCTTGTTGAGGACCGGAACCTGTCGGTACCCCAAGAGGATACTGGCCATCTCATTCAAAGTGGATGCA<br>AGTAGAAACCTGAAGGACAGAGTGGAGAGGAGGTGCGGCTATGATTTGGCGTCAAGGTTTGACAGTTATACT<br>TTCCACGCGTTCGCCAAAAGGATCATCGACCGCTTTAGGCCGGTGCTGACAGGCAAGGACGCCCTCGACGCA<br>GGCTACACCATCGTGGATAAGAAGAATGGCCCTCTAGGACCCAGATCGAGTTCGGCGACCTTGTCCCCCTT<br>GCCATACAAATCCTGCAATCAAGCAAAATTGCACGAAACGCGATCCGCCAAACTTACAGCGACATCTTCCTG<br>GATGAGTTTCAGGACTGTACAAACCTGCAGTACGACTTGGTAAAACTTGCGTTCCAGGGTACGTCAATACGG<br>CTGACGGCTGTTGGCGATACCAAGCAGAAGATAATGGCCTGGGCTGGAGCCCTGGACGGCATTTTCCAGACG<br>TTTGCCAACGATTTCAACGCCGTGTCCCTGAACATGTATAGGAATTTCAGAAGCAAGCCACAACTGCTCAGG<br>GTTCAAAATGAAATTATCAGGAAGTTGGACCCCGATTCCGTGACTGACGAACAACTTGACGGTGATGAA<br>GGCGAGGTCTATGCGTGGAGGTTCGAGGATAGCTGCAAGGAAGCCGTGTATCTTGCGGACCTTATCAATGGC<br>TGGATCAACACCGAACAGCTGCCCCAGCGGAGATCGCCGTACTGGTCAGCAAACAGCTCGACCTCTATGTC<br>GACCACTTGATGACTGAGCTCGAGGCTCGGGGAATCCCCTACAGGAACGAGCAGCAGCTTCAAGACATCACC<br>ATAGAGCCGGCAGCTAGACTCATTGGGACTACTTGAGTTGCCTCTACGGCAAGAGAGAGCCGAAAGCATGG<br>ATCCGGCTCATGAACCAGCTGATCCCATTCGCGGACGAGGAGATCCAATCTAGTGCTCGAAAGGACCTCGAC<br>CAGTTGATAAAGAAGCAGAGAAAAGGGTGAGCGACGCGAAGCACACCGATTCACCTTTCAGCGATTGGGCA<br>CAACTCGCAATTGAATTCCTGAAGTACATAGGCAGTAAGATGCTGGTGGCACTGAGTCCAGATTACGAGACG<br>CGCGAGAGGCTGAATGACGTGATCAGGGAAACTTTCGCGAGGATCAAGGAACTGTTGAAGAGCGAGCCCGAC<br>CTGCCCAAGGCGCTGGGCCGGTTTGCCGATGACCAGGCGGTGCGAATACTGACCATCCACAAGAGCAAGGGC<br>CTGGAATTCGACAGTGTGATCATCATGGCCGTCGAGAACGAGATATTCTTGGGAACCAGGACGAGAATAGG<br>TGCGCTTTCTTCGTAGGTGTGAGCCGAGCAAAAAGGAGGTTGATACTTACCCACGCCGACCAGAGGGAAAGG<br>CCAGCGTCTGCCAAGCGATGGAATGTTAGTAGAACCGCTCAGACTGAGTACATTAGTTACGTCACCCCTTTC<br>GTGAGGCCACAG |
| 170 | 21 | GTGGCCGCTTTGAAGCGCTACTTTAATGACAAGAACCTGATCGTGATAGGCTACTCTGGCAGGGACAAGAGC<br>CTGATGAGTGCGCTTACCGAGGCTTTCTCTGAGAAGGGCTCTGGCCGCATCTACTGGTGCGGCTACGGCAGC<br>CACATTTCCCCCGAGGTGGAAAGCTTGTTGAGGACCGCGCGCAGGACCAAACCGCGACGCCTACTATATCGAC<br>ACCGATGGGTTCGACAAAACCATGTTCAGCCTGGTAATAAACTGCTTCCAGGCGGATATCGAAAAGAAGAAA<br>GAGATAATGAGCATCCTGGAGTCTGCTCCCGAGGACAACGATACCAGCCCGTTCTCAATTCACATCACCAGG<br>ACGGATAAATACCTTAAGTCCAACCTCTACCCGATCATCTTTCCTAAGGAGCTGTTTCAGTTTGAGATAGAA<br>TATCATGAGGGCGAACGACCATGACCCTGCTGAGAGAGATCACCAAAGACCAGAACATCATCGCCGTGCCC<br>TACAAGCAAAAGTCTACGCCTTGTCAACGGGATCAGCTATCAACAACGTGTTTGGTAGCCGGTTGAAATCA<br>GATATAGAGAGGATTCCCGTGTCTATGGATGACATTGAGCGCAAGTCTAGTTACAGGGAGCTCTTCCTGAGG<br>GCCACCCTTCAGTCTATAGCCATTATAAGGGGCCTGAACGTGGACATACGCACAATACCCTTTGGCGGAGC<br>GACATCTTTAGGAACGACAATGGCACCCTCATCCACGAAGCGATCGAGTGTTCCCTGGTGTTTGTGCCCCAA<br>CAGAAGTATGCCCTGTTGAGCTTGAGGCCCACCATCTACATAGAGAACTCTCATACGGTTAGCAAGGAGAAA<br>AAGCAGGAGTACGCCAGGATCTACCTGGATAAGATGTGGAATAAAGCGTACAGCACGAAGTTGGCCCAGTGG<br>GAATCTATAATCTTTGGAGACACGAGGCTCGCCTTCGAGGTGCCGCAAAATTCAGGATCCGGGTTTAAGTTT<br>CTGATAAGCCACAACTGCGGCTTCAGCGAAATCCAGTATCAAGACAACACCGAAAGGGGGATACAGTAGCAAG<br>AGCTACGACAACAAGAGGACGATCTATAGGGGCTTGCAGCTGCAAGGAACCCGAGCTGGAATTTGTCAATACG<br>TTTGCAGACCGGCCCTTCCTGGACAGCAACCCCATGCGAGGCCTGAGCAATCACAGGCCGTACGACAGCTGG<br>CAGAAAGACGTTCTCTTGCAGAACGTGCGGTTGGGCGTGATTTGCCCGAACACGCACACCGACCGATTCCAC<br>TCTTTTCTGCAGCAGCTTAACACCACAATTCAAGCCAATGACGATAGCGACTACATTCAGTCCTACACCGGT<br>TTCCATAGCATTTACAAGACTCTGCTGGAAATCCCCGATAACGGGACCGACAAATGGATAAACATCGAGGAT |

TABLE 18-continued

Argonaute and helicase DNA sequences

| SEQ ID NO | Argonaute # | Sequence |
|---|---|---|
| | | ACCCCCAAGGACACCATCAGTCTGGTTCAGAGTATATGTCACCAAGCGAACCGACTGGCCGACAAGTACCCG<br>GGCATCGTGGTGGTGATTTTCATCCCCGCATTTTGGTCTATCCATCGACAGTTCAAACACAACGGGGAGAGC<br>TTCGATTTGCACAACTACATCAAGGCCTACGCCGCACAACATAGCTTCACTACCCAAATCATTGAGGAAAAG<br>ACGCTGCGCGACCACATGGTCTGCGAAATTTGTTGGTGGCTGTCACTCGCACTGTTCGTTAAGGCTATGCGA<br>ATCCCGTGGGCACTGGCCAATTTGGACTCTGACACCGCTTACGCGGGTATAGGGTACTCAGTGAAGACCAAC<br>AGCAAAGGCAACGTCGACATAGTGCTTGGATGTTCACATATATACAACGCAAAGGGCCAGGGTCTCAGATAC<br>AAACTCTCTAAGGTCGAGCAGCCCCAATTCGATGGCAAGAAAAATCCTTACCTTACGTATGAAGAGGCCTTC<br>AAGTTTGGAATTACCATACGCGAGTTGTTCGTCAAAAGTATGGACCGGCTTCCCAGGAGGGTTGTGATTCAC<br>AAGCGGACGCCGTTCAAAAAGGAGGAAATAGAGGGAATCACTCACGCGTTGACTCAGGCTGGCATTAAGGAC<br>ATCGATCTCATTACGATCAATTACGAGTACGACGCAAGTTCATAGCGCAGAAGGTATACTATGACAACATC<br>AGCGACGATTCATATCCCGTAAGTAGGGGCACCTGCATCAAATTGTCCAGCCGAAATGCGCTGCTGTGGACA<br>CACGGCGTGGTTCCCTCAATCCGGGAGAGACGACGCTACTACCCCGGTGGGCGCTGTATTCCCGCACCCCTG<br>AAGATAACAAAATACTACGGTAAAGGCGATCTTCCGACAATCGCCAGCGAGATTATTGGATTTACTAAGATG<br>AATTGGAACAGTTTTAATCTGTACACGAAACTGCCCGCCACCATAGATACGAGCAATACATTGGCGCAGGTC<br>GGCAATCTGTTGCATCAGTATAACGGCGCAACTTACGACTACCGATATTTCATC |
| 171 | 63 | ATGGTCGCGCTGAGGCTGAACGGCGTACCCATCTTGTGCGCCGCTGACGTAACCGTGGCCGTGGCGAAGTTG<br>CCGTACACGAAGGAGAGCCTGGACGAGTTGAGGAAGGAGCATGCGGGGAGGTATTTGATTAGGAGAGGCGGA<br>GATGACGGGCAGGAAATCATGTCTGTTCCCTTGCTTGCTGATGCTCCGCAGCTGAGCGATGCCGTTGTGGAA<br>GTTAAGCTGTCAGAAGCCCACTGGTTGCTCGCCTCACTCGCGGTGGAGGCCCTCACCAGGTTGTTCACAGAA<br>CTTGGTAGACCTATCCTGCGGTCCCGGCCATTGCGGCTGCTCTCCCAAAAGCCGGCCAATCTTTTTCCGGAG<br>AACGTCGGACTGCCAGACTGGCTGCAAAGGAGGGTTGTGCTGGATTTGGAGACTAGGAAGATCTGGCGGCAG<br>GATGGGAGACCCGACATTGGTGCTGCTGTGCGATGTGCGGACTCAAAACTTTATCGACGTGCCAACGGATAAA<br>CTGATGGCCACCGGCGTAAGCGTTATGGGTCGCTACGTTAGCCGAATGGTGAGCTCTGATGATCCCCGGATC<br>ACCTCACATCTGAAGCTCGCCGGCAGGGTCATTAGCATAGAGGGCGACCGACTGCTCCTCGCCGACTTTGGC<br>GAGGGACCGGATAGTATAAGCATTGCTCATGCCTATCTGGAGAGACGACGGGAAAATGTCGACTGGTGTGTT<br>CAACAGCTGAACCCCGCGAAAGCAGGGCAAATCCTGATGAGCGTGCAGGCCGAGGCTGCGAAATTCTTGAAC<br>GGACCTGGCCGATTCGAGCTGATCAAGAGGACATTCGATTACCTGCGCACGCAGAGTATAGAGCTTGTGCCC<br>GACGTGAAGCTGGAGTTGGGGGACTTGATTGGCATGGGAGCCGCACGCTGGCCCTTCCGCCAGGAAACAATT<br>AAGAAGCCTACCCTGGTGTTTGATCCGTCTGGTGTCAAGACCGATACCTGGAACGAGCGAGGGCTTGACAAA<br>CACGGACCCTACGACCAGAGGACCTTCAGCCCCAAGGAAATGAGGATCGCCGTTATCTGCAGGGAAGCAGAC<br>GAAGGTCGGGTTGAAGGATTTCTGGCCAAGTTTCTGGACGGGATGCCACACGTTATCGTCGGGGAGAACCGA<br>AAACCCTATGAAAAGGGATTCATAAGGAGGTTCGCCCTGAGTGCCCCGAAGGTGCACACTTTCACCGCTAAG<br>TCTTCTAGTGTGCCGGACTACCTGAATGCGTGCCGAGCGGCCCTGAAGTTTGCCCACGACCAAGGCTTTGAA<br>TGGAGCTTGGCAATCGCGCAAATCGACAAGGACTTTCGGGAACTCCTCGGTCCTGACAATCCCTACTTCGCG<br>ATCAAGGCCGCGTTTCTCAAGCAGAGGGTGCCCATCCAGGAGTTGACGCTCGAGACAATGAGCACCCCCGAC<br>AGGCAGCTGGTGTACATTTTGAATAACATAAGCCTCGCAAGCTACGCCAAGATCGGCGGCATTCCGTGGCTG<br>CTTAAGAGCGGTCCTACCGTGGGCCACGAGCTGGTCATTGGTATTGGTAGCCAGACCGTTAGCAGTAGTCGA<br>TTGGGCGAGAAGCAACGGGTGGTGGGCATTACCACCGTATTCACCCACGATGGCAGATACCTTTTGGACGAC<br>AGGACGCGAGCCGTGCCATACGGCGAGTACGAAGCAGCTTTGTCCGAGACGCTGACCAGGGCCATAGAGAGG<br>GTAAGGACGGAAGATAACTGGAGGTCAACCGACGCGGTGCGACTTGTATTCCACGTGTTCCAGCAAATCAAA<br>GACTACGAGGCCGACGCAGTGGGGAAACTGGTCGAGAATCTCGGCTTCAGCGATGTCAAGTACGCCTTTGTG<br>CATGTCGTTGACAGCCACCCCTACACCCTGTTTGACGAACACATGCCAGGCGTTAAGTTTGGCTACGAGATG<br>AAGGGCGCCTACGCACCTGAGAGAGGCCTGTGCATCAGTCTTGGCAGGGACGAACGCCTCCTCAGCTTTACC<br>GGGTCTGGGGAGGTTAAACAAACCCATCATGGCCTCCCAAGGCCAACCCTTCTTCGACTGCATAGGAACAGT<br>ACCTTCCGGGACATGACCTACATCGCCAGGCAGGCTTTCGACTTCGCAAACCACTCATGGAGGATGCTCACC<br>CCAGCGCCCCTCCCCATCACCATCCACTACGCCGAACTCATCGCCCGGTTGTTGGCTGGTCTGAAAGACACA<br>CCCGGCTGGGACGAGGACACAATGCTCGGCCCAGTAGGTAGAACCCGATGGTTTCTG |
| 172 | 33 | ATGAACTACACAGCCGCCAACACGGCCAACAGCCCATTGTTTCTCAGCGAGATTAGCAGCCTTACCTTGAAA<br>AACAGCTGCCTCAACTGCTTCAAACTGAATTACCAGCTGACTCGCGAAATAGGCAATAGGTTCGGCTGGCAG<br>TTCAGTAGGAAGTTCCCTAACGTTGTGGTGGTGTTCGAGGACAACTGTTTCTGGGTTCTCGCTAAAGATGAG<br>AAGAGCTTGCCCTCTCCTCAACAGTGGAAGGAGGCTCTGAGCGACATCCAGGAAGTGCTGCGAGAGGATATC<br>GGAGACCACTACTACAGCATCCACTGGCTTAAAGACTTCCAGATCACCGCCTTGGTGACCGCCCAGCTCGCC<br>GTGCGAATTCTGAAAATCTTCGGTAAATTCAGCTACCCCATCGTGTTCCCCAAGGACAGTGAAATTAGTGAG<br>AATCAAGTGCAAGTAAGGCGAGAAGTCAACTTCGGGCCGAGATCATTAACGATACCGACCCCGCCATTTGC<br>CTCACCATCGAAAGCAGCATCGTCTATTCCGGCGATCTCGAGCAGTTCTACGAAAATCACCCGTACAGGCAA<br>GACGCCGTGAAGCTGCTGGTGGGCCTGAAAGTTAAGACCATTGAGACAACGGCACCGCTAAGATCATCAAA<br>ATCGCTGGCACTATAGGGGAAAAGCGCGAATACCTGTTGACTAAGGCCACGGGAAGCATATCCCGGCGAAAG<br>TTGGAGGAAGCCCACCTCGCACAACCCGTGGTTGCGGTGCAGTTTGGTAAAAACCCTCAGGAGTACATATAC<br>CCCCTGGCTGCCCTCAAACCTTGCATGACCGACAAGGATGAGAGCCTGTTCCAGGTCAATTACGGCGACCTC<br>CTGAAGAAAACCAAGATCTTCTACGCTGAACGACAGAAATTGCTTAAACTGTACAAGCAGGAGGCGCAGAAG<br>ACTTTGAATAACTTCGGTTTTCAGCTTCGGGAAAGGTCCAATAGCAGGGAAATCCAGACTTCTTCTGG<br>ACGCCCCAATTTCATTGGAGCAGACCCCATCCTGTTTGGGAAGGGTGAGCGCGGTGAAAAGAGGGAGACC<br>CTCAAGGGCCTTTCAAAGGCGGAGTCTACAAAAGGCACAGGGAGTACGTTGATCCTGCCAGGAAAATTAGG<br>CTGGCCATCCTTAAACCGGACTCTTTTAAAGTGGCGACTTCAGGGAGCAGCTGGAGAAGCGACTCAAGCTG<br>TATAAGTTCGAGACGATTCTCCCCCCTGAGAACCAAATCAATTTTTCTGTGGAGGGTGTTGGGAGCGAAAAA<br>AGGGCCCGACTGGAAGAAGCCGTAGACCAGTTGATAGGTGGCGAGATCCCCGTGGACATCGCCCTCGTCTTT<br>CTGCCCCAGGAGGACCGGAACGCGGACAACACCGAGGAAGGCTCCTTGTATAGCTGGATCAAAAAGAAATTC<br>TTGGATACGGGGGTGATAACACAGATAATATAGAAAAACTCTCAACAATAAGAGCAACTACAATAACATC<br>CTGCACCAGGTGGTTCCCGGCATATTGGCAAAGCTCGGAAACCTGCCGTATGTGCTGGCCGAGCCTCTTGAA<br>ATCGCCGACTACTTCATCGGCCTGGACGTCGGAAGGATGCCTAAGAAGAATCTCCCTGGTTCACTGAACGTG<br>TGCGCGTCCGTTAGGCTCTACGGAAAGCAAGGTGAATTCGTCCGATGTAGAGTCGAAGATAGCTTGACCGAG<br>GGGGAGGAAATCCCCCAAAGGATTCTTGAGAATTGTCTGCCGCAGGCAGAACTTAAGAACCAGACCGTCCTG<br>ATCTACAGGGACGGGAAATCCAGGGTAAGGAGGTGGAAAACCTTTTGGCTCGGGCACGAGCCATCAACGCC |

TABLE 18-continued

Argonaute and helicase DNA sequences

| SEQ ID NO | Argonaute # | Sequence |
|---|---|---|
| | | AAGTTCATCCTGGTAGAGTGCTACAAGACCGGCAGCCCGAGACTTTACAATTTCGAACAAAAGCAGATTAAT<br>AGCCCCAGCAAGGGGCTGGCGCTTGCATTGAGCAACCGGGAGGTCATCCTCATCACCAGCCACGTTAGCGAA<br>CAGATCGGCGTGCCTCGGCCTCTCCGCCTGAAGGTGCACGAACTGGGAGAACAGGTGAACCTCAAGCAACTT<br>GTGGACACGACCCTGAAACTGACTCTGCTGCATTATGGCTCTCTGAAGGAACCTCGGCTTCCAATCCCCTTG<br>TACGGAGCCGACGCCATCGCGTATAGGAGGTTGCAAGGAATCTATCCAAGCCTGCTGGAGGACGACTGTCAG<br>TTCTGGTTG |
| 173 | 19 | ATGAACTACACAGAGGCCAAGACCGCCAATAGCCCCTTGTTCCTTAGCGAGATTAGTAGTTTGACACTTAAG<br>AATAGCTGCCTGAATTGTTTTAAGCTGAACCATCAGGTCACCCGGAAATAGGCAACAGGTTCTCTTGGCAG<br>TTCAGCCACAAGTTCCCTGACGTCGTGGTAGTGTTCGAGGACAATTGCTTTTGGGTGCTGGCTAAAGATGAA<br>AAGAGTTTGCCTAGTCCACAGCAGTGGAAGGAAGCACTGTCAGACATACAGGAAGTGCTGAGGGAAGACATT<br>GGGGACCACTACTACAGCATTCACTGGTTGAAAGACTTCCAGATAACCGCCCTGGTCACCGCGCAGCTGGCT<br>GTGCGGATTTTGAAGATATTTGGGAAGTTTAGCTACCCGATCGTGTTCCCCAAGGACAGTCAGATCTCTGAA<br>AACCAGGTGCAGGTGCGAAGGGAAGTGGATTTCTGGGCTGAGATAATCAACGACACGGACCCAGCAATATGC<br>CTGACGGTGGAAAGCAGCATCGTTTACTCTGGCGACTTGGAACAGTTTTACGAAAATCATCCGTACCGACAG<br>GACGCCGTGAAACTTCTCGTAGGGCTGAAAGTGAAAACTATCGAAACCAACGGCATCGCGAAGATTATCAAA<br>ATTGCCGGGACCATCGGAGAAAAGCGGGAGGAACTGCTGACCAAGGCAACCGGGTCCATAAGCAGGCGCAAA<br>TTGGAGGAGGCACACCTGGGCCAACCTGTGGTGGCCGTGCAGTTCGGCAAGAATCCGAGAGAATACATCTAT<br>CCCCTTGCCGCGCTCAAACCGTGTATGACCGACAAAGACGAGAGCCTGTTTCAAGTGAACTATGGCGAGCTT<br>CTGAAGAAGACTAAGATTTTCTACGCCGAACGGCAGGAGTTGCTGAAATTGTATAAACAGGAGGCGCAGAGA<br>ACGCTGAACAACTTCGGCTTCCAGCTCCGGGAGCGGTCAATCAATAGCAGGGAGAACCCCGACTTTTTCTGG<br>ACCCCCTCAATTTCCCTTGAACAAACGCCCATCTTGTTTGGCAAAGGTGAGCGAGGTGAGAAACGAGAGACC<br>TTGAAAGGCTTGAGCAAAGGCGGCGTGTACAAGAGACATAGGGAGTACGTCGACCCCGCGAGAAAGATTAGG<br>CTGGCCATCCTGAAGCCGGCCAATCTCAAGGTTGGGGATTTTAGGGAGCAGCTCGAGAAGCGACTGAAGCTC<br>TATAAGTTCGAGACCATCCTTCCCCCCGAGAATCAAATCAATTTTAGCGTAGAGGGCGTGGGCTATGAAAAA<br>CGAGCCCGCTTGGAAGAGGCCGTGGACCAACTGATTAGGGGGGAGATACCCGTGGATATCGCTCTTGTCTTT<br>CTTCCGCAGGAGGACCGAAACGCCGACAACACCGAGGAGGGGAGCCTTTACTCATGGATCAAGAAGAAGTTC<br>CTTGACAGGGTTGTGATAACGCAAATGATCTATGAGAAAACGCTTAACTATAAGAACAATTACAAGAACATC<br>CTCGATCAGGTGGTGCCTGGAATCCTTGCGAAACTTGGTAATCTGCCTTACGTGCTCGCAGAGCCACTGGAA<br>ATCGCCGACTACTTCATTGGCCTGGATGTGGGTCGCATGCCTAAGAAAAACCTCCCCGGGTCACTTAACGTG<br>TGCGCGTCCGTAAGGTTGTACGGGAAGCAGGGCGAGTTTGTGCGGTGCCGAGTCGAAGATAGTCTCACCGAA<br>GGTGAAGAGATCCCCCAGAGAATCCTGGAGAATTGTCTGCCCCAAGCCGAGTTGAAGAACCAGACCGTGCTG<br>ATATACAGGGACGGTAAGTTCCAGGGCAAGGAGGTGGATAACTTGCTGGCCCGAGCCCAGGGCCATTAAGAGC<br>AAATTCATACTTGTCGAATGCTATAAAACGGGCATCCCCAGACTGTATAACTTCAAGCAAAAACAGATCGAC<br>GCGCCCAGTAAGGGCCTGGCGTTCGCTCTGAGTAACAGGGAGGTGATCCTGATCACGTCCCAGGTTAGCGAA<br>AAGATCGGCGTGCCGCGACCTCTGAGGCTTAAGGTACATGAGCTGGGAGAGCAGGTAAATCTGAAGCAACTG<br>GTGGACACCACACTCAAGCTGACCCTGCTCCACTATGGGTCTCTTAAGGACCCGAGGCTGCCCATCCCCCTT<br>TACGGCGCTGACATCATCGCGTATAGGAGGTTGCAGGGAATATATCCCTCTTTGCTGGAGGACGATTGTCAG<br>TTCTGGCTG |
| 174 | 85 | ATGACTAACAAAACCAAACAAAAAAGCAGGAAGCAGAGGTCCCTCATAGAATTTCTTAAGGTGAAGAAGATC<br>AACAAGGAAGATGGTAAGAACCATAACCTGATCAAGTATAGCACCGAACGGATCGATACAGGAGTGACCCAG<br>AGCCTCATTGACATCAATATATCCAGTAACATCCTTAAGCTGCGGGGCAGCATTGCTCAAGAGGTGTTCAAA<br>CGGAAAATTGGCGTTTACTACGGGCTTGGGAAGTATTACGTTGCCGAAAACAAGCTGAAGAACACCGATCGA<br>ATGGATTTCTTGAAGAGGGTCTACGAGACCTTCCCCTATAACTACCTCGATAAACAGGACCCGCACAGCAAG<br>ATCAGCTTTTACGAGTACTACACATTCCAGAAGTCCATCGACAAAGACGTGATAAACCTGCTTGAGCTGCAG<br>AAGATAAACGAGTATAGTTGGGACATACTGGACCCACACATCGCCACGCGCCTTCTCACAAGCTATGTGAAG<br>CTTTACTTGGGCGACTACTTGAAGCCAATCCTGTCCTCTTTCGAGTACGTCCGGGCTCGAATCAAGACAAAG<br>CAAAAGACCGTTCCAATCAAAATCCCCGTGACCAAGAAGTTCGAGATCCGAACTTTGGGGTACGACCCGACG<br>CAGAGCGAAATTACTCTCGCCATAAAACGACACGCCAGCATGAACGCTGTGCTGTTGAGCAGCTTTCCCCCC<br>GACATCCTCGCGGTTGTGATAACTAAGCTCAAACGCCTCGTGAACGAGGCCGTGAAGCAAGACTACCGAAAG<br>GTCAGAATATACTCCGAGACCCAGCCGGGGAGCGGTACTGCCGCAGTTGTTGAAATCATCAGCGGCAGCCAA<br>AACGTGATGAAGTTTCTCGAAGAGCATCCGAAGGGGGCCATCCACGTTGAAAAGCGACTTAAAGAGCTGGGT<br>AAATCACTGCAGGAGGTCCGGTACCTTCTTATCGGCGTCTATGACAACAACGTCAGCCTGGAGCGGGCAAAA<br>AAAGACGAAAGATACCACTACTACTTCACCGAGCATAACGCTTACCTTGTACTTACGCCCGAGGTGCAAAAG<br>GCGCTCTTTGGCAAGTTGATCGACGACTGGAAGACAAGCATTCTGAATGAGTACCAAAATAAGCTCCACGAG<br>ATCACGAGTCTTGGGATGTTTAAGCATTTGGAGACCATACGGGGCATCTCCGGTTTCCTTGAAGAGAGGCTT<br>GTGGTCCGCACCAGCGAGGGCTTGCAAACCGTAGATGACATTAGGGACATTTTGACCAACCCCAAGATTCTT<br>AGTAATATGTTGCCTATATCCGAGGACGCGCTCAAGGAGACGCGAAAGCATAAACTGCGAATCACCCTGTTC<br>TGTCCGGAGAAGTTTAGTGAGAGGATTCACCGGACTATTTTCTACGACAAATTGAACCAGTTTCGAGACGGT<br>CTGCTTAGCAACAGCTTCGCAAGCGTGGACGAAATCGAATTGTTCCAGGTCAAAGGCGAAAACTCTAGCGAT<br>TATGAGGAGATCATGAAGGACGCTGGCCTTGATAAAATCCACGATTATACCCTGGCGGTCATCATATTTCCC<br>GAACATTATAGTAAGCGCAACCTTGAGTTGCGCATCTTTTACAACTGGCTGAAAATGCGGTTCTACTCAGAG<br>AACAAGCCACTGGTTTTCCAGGGCGCTCGGATTGACAGCGTCTTCGGCCGGTATGCGAAGTACGCATCATAC<br>AACCTCATCTTGCAGATCCCACCTAAATTGGGCATCTACCCGTACTCACTGGAGGAGCACGAGGACTATGAC<br>TACATCATCGGCATTGATTACACCTATTGGTACGAGAGAGATACGCCTAGTCTGGGCGGTGGCGCCGTGTTG<br>ACCAGCCGTCAGGGCTGATTGAGAGCATATACCCCATCGCACTCCCGAGCCGCACTGAATCCCTCAACATG<br>TCCAAGATACTGAGCGAATGGTTCACGCGAACAGTCAAAACGAACCGGCATATCATAGATAAGGGCCACGTG<br>ACCGTGCTTATCTCCAGGGACGGCATGATTCCTAAGTACGAACGCCAGACAATCCAGGAGTTCCTGAGTGAA<br>TATAGCGGCGACATGGGCATGACCATAGAGGCAGTAGAAGTTAGGAAACGCATCGCCGTGAGGACCTGGGCT<br>ACACAAGAGCCCGTGGCCTACTACAGCCCGATAAAGGTTGGCGACTGTACCTACTATCTGGTCGACGCGCAC<br>ACCGGATACCCGCTGGGGGAGAAAGGGAACCGAACCTTCTACAGCTCACCCTATCTCATAGGAAGTTTTTAC<br>AGGTTCGAAAAGGGCAAATCCTCCCCCGTGCCAGGTAGCGCAAAGAAGCACGTGATCGAAAGCCTGATAAGA |

TABLE 18-continued

Argonaute and helicase DNA sequences

| SEQ ID NO | Argonaute # | Sequence |
| --- | --- | --- |
| | | CTTCAAAAAATCAATTACGCCACCACCCGCATGGATAACATCAAGTTGCCCCTGCCCGTCGACATCACCCAC<br>AAACTCATTAACTTTATCCGGGACACCAAGATGGAAATCAAGGGGGTCGGTATCCCAAACAGTCTCTTTATG<br>ATA |
| 175 | 79 | ATGCCGTTCAATAGCAACCTGATCTTCGTGAAGCTCGACGACCTCAAGAGAGCCTTTCTCGAGGGCGTCCAC<br>AGTGGTCACGCCGTGGTGTATGAGGTGAGCGAGGGACTGAGCACCGAGGATCTGAAGAAAAGGCTTATCAAG<br>GCCACGTGATGTACCACTATAGGTATGGAAGGAACGTGTTTGTCTTCGGCGTCAAGGAGGGCACTAAGGTT<br>GACGATCTTGTACCAGGCCGACGACTCGGCGAGCACGAGGTGAAGGAGGTTCTCAAGGGCATCCCGTCTAAC<br>AACCTGGTGTCCATGATGAGCGCCATGCTCAATTACCAGCTCTCTGTGCTTCTCACCAGCAAGGGCTTCCAG<br>TATAGCTACGAAGAGATGCGGAGGGGCAAGTATCTGTGTGTCAGCAACTATTACGGCAAGCTGATACGGAAC<br>CCCGTGAAGGTTTGCCTCAAGGTAAATGTCATAAGGAGCCTCATTGACGAGCAGGATCAGTACCTGCCCATC<br>GCGCTTAACTACAGGGTGAAGAAGAGCAGGCGGCTTAGCCCCGAAGTAATGAATGAGATCCACGCGGAGTTC<br>ATGGAGGCCTTCCCCAGCTACCTCAACGACCTGAAAATCATAACTCGCGTCTTGAACGACGATATGGTGAGG<br>AACAGGGAACTGAAATTCCTGGAGATCGAGTACAAACCCCCTGCTATCATTACGTTCCGGTTTCGAGGCAAC<br>AGCACCGGCGAAAACGTGACCGACATTCTGAAGCTGGGCCCCTACTTCCTGCCTGGGGAGGAGGAGAAGATC<br>GATGTGGTCTTTGTGTACGAAAATGCTCTCGCTAGCCAGGCAGGAAAACTCACCAAGGTTTTGGAGGATACC<br>ATCAAGGACGGGCTGGGCATAAAGCTGAACATAGACGACGAACATAAGTTCAGCCACGACAAGCCGCTGGGC<br>GACGTTATTAAGCTGGTGCGCGACCGATTCATCAACAGCGGGAGTTGTCTGCTGGTCCTTAGCAAGGAGAAC<br>CGCCTCGGTCCTATCTTCATGAGCATTAAACCGCTCACGCTCAAGAAGAACTTCTACTTCAAGTCTCAATTT<br>ATCACCAACGAAACGATTAGCAAACTGGACTCTTATGCGGTCAAAGCCAATATCGTGAATGACATCCTGTTC<br>AGGGTTGAAGGTACCCCGTACATGCCCGTTCTGCGGGGCAATATAGACGTACTGGCAAACAATTTGTTCGTG<br>GGCATCGCCCTGAGTAAGCCTCTGAGGAAGGGCTACACCAAAGGAGGCATAGCCCTCATAGACCCCTACAGC<br>GCCCGAATTATCACAAGGGCCATCGTGTTGAAGCGCAAGATGAGGAGCGGCAAATTCGAAGCCTCAGACATG<br>CACGAGATCGTGTCCAACATCAAAGGCGTGCTGAAGGACTACAAGGAGCTGTACAACGTCAACGAACTTGTT<br>ATACATATCTCCAAGTTTCTGAGCGATGACGAATACGGCCTTTTTTACGAGTACTTGCAGGACCTTAATGTC<br>AACGTGCGACTCCTGAGCATCAGGAAGAGGGACGACATTACACTGGTTAGGGACGGGAGGATGGACAGCCTG<br>ACCATGATCAAGCGCGGCAAGAGTCATGTCGAGGTCATGTATTGGCCTCACGAAAGGGCCTACCACCCCCTT<br>ACTATCAGGATCTACGGCGACAATGTGGACAGGGACGTGATGATGCGACACCTGAGGTTTATCGAGCTGCTC<br>CGGCACATGTACTACCCGGCCAGCAGCCGCTTCATAGTTGAGCCCGCGACCATTAGCTACAGCAGGAGGGTC<br>GCCAGATTTGCCCCCTGGCTTTCAGACAATACC |
| 176 | 84 | ATGGAAGTGTCCCCCTTCTTCAACGAACTGTTCAAGTACTACATATTTCTGTTTTTGGTTTCAAGGTGAAC<br>ATCGTGAAATCACATTACCAGAGCATTAAGAAGCACAAGATAATATTCTATTCCGGTGGGATCATGGACGAG<br>TATTACACTAACGCCTTCCCCATCAACAAATACTTTATCAACCGCATCATCTCTGAAAACTGCATCCGCTGC<br>CTGTGCAAAATAACCAAGCTCGAGAAAAAGAGAAGATCGAGGAGTTGCTTTACTCTATCAGCGCCACCCTG<br>GGGGGCATTTACATCGACGATTACAACCCAATGAAGAATAAGTTCAGCTTCTACATTTGGAAGGGAATCCTG<br>AATAAGAAGATTAAATCCTACGGGTCTGAATGGCTCATTTACAAGGAGAACAATGGGCTTTAAGGATCCG<br>GAAAACAAGACGCTGTTGAACTATGTGAAAAAAAAGTACGAGAAAGACATAAAGTTCGACATCATAAAGAAA<br>GAGAAGATAGAATGGAGTAACCTCGACTGGGAGATAAAGGAAAAGATAGTGCTGGGCGCCATAAAAACTCAC<br>CCTACCATTCGCAAACTGATTGAATACAAGAATGAGAAATTCATTGACAAAATTGGAAAGAAAATTCTGACT<br>TACTTTAGCATCACAATCACCAGCGACGAGAACGAATTACTTTCGTCATCGTCAAGCCCAAGCATAAGATC<br>ATCAGCTCAGAGACAATTTACAACATGCTGAAGAACAACAAAATCGACTTTAAAACTCTTGAGAGGAAGCTG<br>CTGAACGGCAGCGCCCTGATAACCACCAGTAGGGCAGTCGGCAGACGGAAATACGTCAAATCAAAAAAATC<br>ATATCCCCCAAGGAGAAGGAGTATTGGCAACATACCCAGGACATCAATGAGCACTACGAAAAGGAGGGCGTC<br>CCGATCAGCGTCGGCGGTGACGACATCCACTGCTATATCTTCATCGGGGAAGACGATTACGCCTACCACACG<br>AAGAACTCCTTGCTCTACGAGGGTGTGACGGAGGACGTGCAGAAAATACTCTTGGATATGGGTAAGTTCCTG<br>GAGGAGCTGGAGACGGCAAAATCTATCCTCAAGCAGGGCAACCTCATAGACTTCAGTCGCGAATTCCTCAAC<br>ATTAGCACGAAGGACGACTACACCCTTACTCTCCTGAGCACACTGTCCGATATCAAAGTGAAGCTTAAGACC<br>GAGTCTGGTATCATCACAGGCGACTACCAGAAACTTAGGGAGATCTTTGACTGGATCTTCGACAAGAGCTTT<br>AACCCCTTGAAGCCTAAGAATTGCTACCTTCCGCTGAGTATTCCCCCCATACTGAATGACAAGAAAAAGATC<br>GGCGTGTACATCTTCTATAGCAATATTAGCGACCCCGAGCTTAGGTTTATCGAAGGGATCTTTAAGAAACTG<br>GGCCTGATATGCGCCATCAATAAGAGTGTGCCAAAAATTGAGGTTAAACTCAAGAAGGAAGTGGACTTTGAG<br>GACTACGCCAACAGCAGGATCATAATCACCCAGACCGTACTGAGCAATCTCGAGGATGGCGAGCAGCCGTTC<br>CTCATATGTATAAGTCCCTTGCTGCCGAATAACGAGTTCGATGAACTCAAAATGCATCTGTTCTCTCACCCG<br>CAGCTGATATTTCACCAATTCATGTATCCGTTCAACCTTCGAAAGTGCCTTGAGAAAGAATCATTCAAGAAA<br>CCCTTCATCAACTCAATCCGTCTCAGTTCTTTCACAAAATGGGCATGTACCTCTTTAGTCTGTCTGACGAG<br>CTGGGGAACTACGACTTCATTATTGGTTACGACATAAGTAGGGAAAAGGATGACATCGGGAAGATAAAAGGT<br>ATCGGCGGCTCCGCGATCATCTACAACAATTACGGCCATGTCAAGTCAATCATAACGTTCGACGACGTAGGG<br>TCTAGCGAGATAGGCAGGTACGACCTCCTGTTCGCGCAGGTGCACAGCGAACTGATACCCCACCTGAATCTG<br>AACAATAAGCGGAAATTAAGATTCTGCTTCTCAAAGACGGGCGGATTTTCAAAAGGAACTCGAAAAGCTC<br>AGCCAAATCAGCAAGAAGTATAACTTCGAGATCACCTACATTGACGTTCGCAAGAGCACGCTGCTCCGGTTC<br>TGGGGTGCGGAGGGGCAAAGTGGTGCCCGAGTATAAGATAGCTACGGGAAGTTCGGACGCGCATACTAT<br>ATTAGTAGCCATTACTACAACCGCTTTTTCAAGCAACCAATCGCAATCGTGGAAGTACCACATAGACGAG<br>GGCAATTACAAACGCGTGAAATAGAGGAGAATGATATTAAGCAGCTGGTTCTGTTGACCAAGATTAACTAC<br>AGCCAACTGATGCCAGATAAGATGCGGCTGCCCGCACCCGTTCACTACGCACACAAGCACGTGAACGCCGTG<br>CGACGGGCTGGAAGATCAAGGACGTCTCTATACTGAGGAGCGGGTGTCTTCCTACGATC |
| 177 | 81 | ATGGCCTATAGCCTTAACGCTTTCGAACTGGAAATTCCCGACATTGACGCCGACCTCTACAAAGTTGACCCT<br>CAACCCTCTGATGACCCATATCGAATCCTGGGGGGTTTGGAACGGTCCTTCGAGCAACAACTGGACGGCAAG<br>GCCCAGAAATGGAACAGGCCGGAGGACGGAGATTGTATATCGCCGTGATAGGCGCGTCAGAAAGGAAAACT<br>ATCGAGTCCCCCTCCAGCGGTACGAGGGCAGGCTACACCACCACGCATACGCTGGATCGAGTAGCTTTTGG<br>GACAGGATGGTGTTGCAAAGGGCAATTAGCGACTCTGTACGATGGTACATGACCAACTATCAGGACTTTTGG<br>TATCATGAGGATGCGGATGCACTCTTTTATCCTTCTCCTAGAGGCAAAGTGGACGAGTACGACGTCTACACC<br>GGATTTAGTCATAGGGTCGAGTTTTATGACAGCCCACAACTTGTCGTGCGCAGCGTCACTAAGTTCATCTCC<br>AGTGAAAGCCTGGCGGACCGGATCAACCATCAGGGCACAGAAGAAGCAACGGAAAAATACGGTGGTGAGAAC

TABLE 18-continued

Argonaute and helicase DNA sequences

| SEQ ID NO | Argonaute # | Sequence |
|---|---|---|
| | | TTTAGGCTGGACAGGCCGGAACCAACCAAATGTACTTTGCACGGCATCTCAACCGAGCGAACGGTAAGTGAC<br>AAGACGATAGATTTTGGTGACGAGATGCTGTCCGTGTTGGAGTTTGCACAAAGAAAATATGGCAGCGAGTGG<br>GCGGACAAAATCGATCCCGACGAACCATTGGTGCAGATACGCTTCGGGAACAGCGACCCCTACGACACCGCT<br>CCGAGCCTGCTGAATGCGAGCCCTGAGGAGCTGAATCGCAGGCTGACCAGCGAGGCAGCCCTCAGCGCACAA<br>GAAAGGCAGAAGGCCATACAGAACTTCATCGGCAGGATACACTACATCCAGGTTGAAGACGAGAAGGTGAGC<br>GTCAGCGATGACGGCGTACGGCCCACCGAGCAGGGCGACTTCGACTACCCCGATCTTGCGTTTGGCAATGAC<br>GAGGTGCTCAGCACCGGCGTCCCGAACGCGGTAGATCCTAGCCAGGAGGTGCACCCGGGCAACTGGCGATGG<br>ATAATCAGGGACTACCTGGAGGAATACGGCTTCTGGGAGTCACAACGAAAGCTGTCTGAGATCGTGCTGGTG<br>TACCCGAGAGGCAAGAAAGACGGGCAGAGAACCTGTACCAGGACGTTAGGGAGAAGCTTTCAGAGATAGGA<br>GGCGTTCAGATCAGGAGCGATCCACATCGCGTGTGTTACACCGATCAGGTGGAGTTCGACGAATGGGTGGCT<br>GAATTCGGTGACTCAATCGACGGTGTTCTTGGATTGATTGAGGGAGATGGAGACGAATACTACGAAATCATA<br>GATGCATTTGGCGGAGCACCGACCCAGTACGTCAACACTAGCACCTACTCAGAGCACAGAGGGGCGAGCGAC<br>GACGTGATCTTTAACACTGCTTGCGGACTGGCCGTGAAGTTGGGCGCATATCCTTTTGGCCTGGCCAACGAC<br>CTGAACAGTGACGTGTACCTCGGCCTTAGCGTGGCAGGGGATAGAAGCACAACGGCCACCGCCGTTGCCATA<br>GACGGAAGAGATGGGAGGATTCTCTATCAAACAGAGGAACCCCTGGGCCAGGGTAGCAGCACAGTAAGCGAG<br>GGCTATCCCGCTAAGCGAATCATCCAGAGGAGCCTGAAGACCGCCTCAAGCGCCTTTGATCGACCAATCGAG<br>AGCTTCGACATTCACAGGAACGGAGACTTTGGCGACGCTGAGCTGGAAACCCTTAGCAGTGAATTGCCTGCA<br>CTCCAGGACCAGGAATATGTGCATACCGATGTTTCATGGAGCGCCGTCGAGGTAATTGAAAACCACCCTTAC<br>AGGCTCTTTAGTGAACGGGGCAGCAGAGCTCCCGATACCGGAGCCTATGCTAAGCTGGACGACGAGCATGTA<br>CTGGTTACTACCTTTGGAGAGCCCCAGATCCACCAAGGTACGCCAAAACCGGTCCTGTGCAAGAGGAGAGCA<br>ACGAGCCAAGATCAAGACATCACCGCCATCGGAGAGGACGTGTTCAAACTCAGCTTCCTTAACTGGGGTAGC<br>CCAATGATGAAGATGAAGCCACCTGTTACCACTAAGATTCCGAAGGAACTCAACGAGATTTTCGAGAAGTGC<br>TCTAGGGTGAGATACCCCCCCTTC |
| 178 | 83 | ATGAAGACGCAGGATGATATCGCGCACAAGCAACCCATTACCATCGAGGTCCAGATCCTGAAGGAGCTCGAC<br>AAGCCAAGCCCAAAAATGGCCACCCGGTTCCTCGTGGCCGATAGGGACGGCAACAGGTTTAGCCTGGCTATC<br>TGGAAGAACAACGCACTCAGCGACTATGACTGGACGATTGGCCAGTGGTACAGGCTGGAAAACGCCAGAGGA<br>AATGTCTTTAACGGCAAACAGTCCCTCAACGGTCAGCAAAATGCGCGCCACTCCACTTGAGGCCAGCGAG<br>GAGGACGAAACCAGCACGGATGATGTGGGACGGGTCGACACAATCCTGGGTAATATGAGCCCGGACCAGGCT<br>TACCTGAGCCTGTTTCCCATCAGTAGGTCTTTTGATACCCTGTCTGTGTACGAGTACAGCATTGAGGCAGCC<br>GAGGCATTCGAGGATGCGCCGGACACCGTGACCTACAGGTGCGCTGGCAGGCTTCGGAGAATCACGGGTGCG<br>GGGGTCGCTTATGCTGGCTCAATGAGGATCGTGTCAACCCGCAAACTCCCGGACAAGCTCGCGGACCCCTTT<br>AGCTTGAGTGAACCCACGGAGAGGGAACTGAACGCTACGGACGCCAGGGACAGGCATAGGATAGGCGGCTT<br>CTGAAGAGCCTCGTGAAGGCCGCCATCGACGATAGCACCTACGACCCATACCAGATCAACCGAATCAGGGCC<br>AGGACCCCGAGCATTACCGCTGGCGACGGGCTGTTCGAGGCGTGCTATGAATTTGCAGCAAGGGTCGATGTG<br>ATGCCCTCCGGCGACGCCTTCGTGGGAATTGAGGTAAGGTACCACACGCGGAGCCAGGTCACTGCAGACGTT<br>TACGAAGACAAAACCGCGGAACTGGTGGGCACCATCGTGGAGCATGACCCAGAGAGGTACAACATTAGCGGT<br>ACGGGCCGAGTAGTGGGTTTCACTGACCACCACTTCACCGACGCCCTCGACGAATTGGGCGGTCTTAGTTTG<br>GCGGACTGGTACGCGCAGAAGGATCGCGTCCCAGAGGGGGTATTGGAGGCGCTGCGAGAGAAAATCCTAGG<br>TTGGTTGATATTCAGTACCAGGAAGACGAACCAGCCAGAATCCACGTCCCGGATTTGCTCAGGGTAGCACCC<br>CGCAGGGAAGTTGTCAAGGAGTTGGATCCCGCCTTCCACAGAAGGTGGGATCGAGAGGCCAAGATGTTGCCC<br>GACAAAAGGTTCAGGCACGCCATAGAGTTTGTGGATCATCTCGGGTCCCTGCCGGATATAGACGCCACGGTG<br>GCACCCGAGCCTTTGGGGCCGTCACTGTCTTACATGAGCACAGCAGTCGACAGGGAGAAGAACCTGCGCTTC<br>AAAGATGGAAGGACCGCCACCACCCCGTCAAGCGGCATCCGGAGCGGCTATACCAACAACCGACGAGCTTC<br>GACATCGCCTATGCTGTGTACCCCACCGAGTCTGAACAGGAGAGCAAGCAATTCATTTCTAACTTCGAGAACAAA<br>CTGTCCCAGTGCCAGTGCGAACCAACTGCCGCTAGGCACGTTCCTTATGAACTCGGCGGCGAGCTGAGTTAC<br>TTGGCTGTCATCAATGAACTTGAGAGCGTGGATGCGGTGCTCGCTGTGGTGCCTCCCCGAGACGATGACCGG<br>ATAACGGCCGGAGACATAACTGACCCCTATCCCGAATTCAAGAAGGGCCTCGGGAAGCAGAAAATACCCAGT<br>CAAATGATCGTGACCGAGAACTTGGGCACAAGATGGGTGATGAACAATACAGCCATGGGCCTGATCGCAGGG<br>GCAGGAGGCGTTCCGTGGAGGGTGGATGAGATGCCGGGTGAGGCCGATTGCTTCATAGGGACTGGATGTGACT<br>CGCGACCCGGAAACCGGCCAACACCTTGGCGCTAGTGCCAATGTCGTTTATGCCGACGGAACCGTTTTCGCC<br>TCTAAAACGCAGACCCTGCAGAGTGGGGAAACGTTCGATGAGCAGAGCATAATCGACGTGATCAAGGATGTA<br>TTCCAGGAGTTCGTTAGGCGCGAGGGGCGATCCCCTGAACACATTGTTATCCATAGGGATGGCCGGCTGTTT<br>GAGGACGCCGACGAAATCCAGGCCCCGTTCGCGGATAGCGGAGTGAGCATAGACATTCTGGACATCAGGAAA<br>TCTGGCGCTCCGAGGATTGCCCAATACGAGGACAACAGCTTCAAGATTGACGAGAAAGGCCGACTTTTCATC<br>AGTCAAGATGACACGCATGGATTCATCGCCACAACGGGAAAGCCGGAATTTGATGATAGCGACAACCTGGGC<br>ACTCCCAAGACTTTGAGGGTAGTGAGGCGGGCTGGTGACACACCGATGCTGACTCTGCTGAAGCAGGTGTAC<br>TGGCTTAGCGAGGCACATGTTGGCAGTGTGAGCCGAAGCGTTCGCCTGCCTATCACAACTTACTATGCAGAT<br>CGCTGCGCCGAACATGCGCGGGAGGGGTACCTGCTCCATGGCGAGTTGATCGAGGGTGTGCCATATCTG |
| 179 | 87 | ATGAAGCCAGTGAACTTGGATGAAAACAGCCTCAACGACGTCCCGGTAGGCGACACCTATGCTGTCCGCTTC<br>ACTCTTGATGCAGTCTTCGAGAACGAAGGGCAGTATCCCCGGAGAATCTGAAATTCACAGACGGAGGGGGG<br>GATGACCGAACCATCACTATTTGGAAAAACTCTGCACCCGAGGAAATTTACGAGGCGGACTATGAGCGCGGT<br>GCGACGTATCTTATTACCGCCGTCGAGTATGACATCGACGAAGGTAATGACGGCGAGCGATACCAGAATCTC<br>ACAGTCCAATCAGATGCTACCTTGCTGGAGATGAGCGGTCCCCCTAGTACCGAAGAGGCCTTGAAGACGGC<br>CTCGCCGAAACCCCAGATACTAGCGCCGATTCAGGTGACCACGGGTTGACAACCTTTAGGACTACAGACGAC<br>CTGCCGGATTATGACGTCTATGAGTACGAGCTGGTGCCGAAGCAAGGATTCCGGCCGTCCGGAGAAAATGCC<br>CTCCGAGCCACATACAGGGCACGACGCAAGGTCCGCCAGCAGTTGGACGTAACACCCGTCGTGGTCGGCGAT<br>GCGTTTAAGCTTGTGTCTCTGGTCAAGCTGGCCCACGAGCGGGTCGAGCTTCCGCGATTCAAGATCAACGAG<br>GTTGACGAGAGGCCCATCGTCTACGCCGATGAGGATGACAGGATGATGTGTTGGGGGAAATGCTCGTGAGATC<br>CTCAAGGACGCGAAACGGGACCAGTACGACATCCATGGCATCGACAAAATACTGGAGCCAGAGCCCGTCATA<br>GAGAAAGAGGGCTTCAGGCTCCACGAACGGTACAACCTGACCGTGGAAGTTCTCCCTAGCAGGGCCGCTTAC<br>CTGCACGTGGACTATCGACATCGGATATTGAGCGACAGGACCCTGGATCAACTCGATGAAGACGAAATCCAC<br>CCTGGCCTGCGCGTGACCCCTCATATAGGGACATGGGTCTGTACGTTATAGGCGTTGGCCGGAGACGGTG<br>ACCGATAAGCTGCATATCGAGGGCAACAAGAGCCTGGTCCAATACCATCGGGAAGAGCCGTGGGTGGACCCG |

TABLE 18-continued

Argonaute and helicase DNA sequences

| SEQ ID NO | Argonaute # | Sequence |
|---|---|---|
| | | GCGAAGGTGCAAGAAATCAAAGACGCAGATAGGGAAGTGATCTGGACCGTGAGGCAACGGGGCGATGGCACC<br>GAGATGGCATTCCCGCCGGAGCTGCTCGCGCTTCAAGGGCACCCCGAAAATTTGGCCCAGTTCGCCAGCGAC<br>TTTGCTGAACAACAAAGGCTCAACACGCGCCTTTCCGCTGAGCAATGCATCACCAAGGCTAAAAGGTTTGTG<br>GAGCGACTCGGGCCCTTGCAATTCGACGGACACACTGTGGAATTCGAGACCAACCCGCTGTTGGGCGATCGG<br>AACATAGCCATAGATGGTCTGTTTCACCCGGAAGCAAACGTGCTGCAGTTTAGCGGAGGCCAGACCGGCACC<br>CACCCCTCAGATGTGACACAGCTGGGCGTGTACGAAGCCCCGGACCCCTTCAGGGTGTGCCACATCAGGATG<br>GAGAAGCGGGACAAAAGAATACAGAGGGGTTGGAGTACCTTGGAGACGAAGCTGGAGCAGATTGGAGCGCCT<br>CCCGACAGTGTCGAGGAGGTCACGTTCGACGCCACAATGAGCCCTGACCAGTTGGGTATGGAGATAGCGGCC<br>GAGATACCGGACGACCATGATTACGACGCGGCCTTCTGCACATTGCCACCTAAAGACACCGGCTACTTTGAC<br>ACCGCAGACCCCGAGCGAGTTTACGATGAACTTAAGAAAGTGTTGGCCACCAAAGACCTTAACTCCCAATTC<br>GCGTATGAAGCAACGCTGGACGAGCGCTTTACAATAATCAATATAGCACTGGGTCTTGTCGCCGCAGCGGGA<br>GGTATTCCGTTCACAATCGAGAGGGCGTTGCCAGGCGATAGCGAACTCCACCTGGGAATCGATGTAACCCAC<br>CAATACGACGAGTCCGCGAATGGCAACCACATTCACCTCGCTGCTGCGACGACGGCTATCCACGCTGATGGA<br>GCTGTACTGGGCTACACCTCCAGCCGCCCTCAGTCTGGGGAAAAGATTCCCCCCAAGGGAGCTGAAAGAGATC<br>ATCAAGCAAGCGGTGATGGGCTTTCGCACACGCTACGATCGCTACCCAAATCATATAACCATCCACAGGGAC<br>GGGTTCGCAAACGAGGACCTGTCCGAGGTAGAAAAGTTTCTGACGGACCTCGACGTTGAATATGATGTTGTC<br>GAGATCAGGAAGCAGGCCCCAGCGCGCGTCTTGAAATACAGTGGTGCCCACTTCGACACGCCTCAAAAGGCG<br>ACCGCCGCAATCTACGAAGACATCCCGAAAGCGATTGTAGCGACGTTTGGTGAACCCGAGACTCTCGCTAGC<br>CGGGAGTCAACCGGGCTTCCCCAACCAATCACGGTGGAAAGGGTGCACGGAGAGACCCCCATCGAGACACTT<br>GCTGCGCAAACCTACCTGCTGAGCCAAGCCCACATAGGCGCCAGTAACGCTACAGCACGCTTGCCCATAACC<br>ACCATGTATGCCGACTTGGCTAGTGCAGCGGCAGCCAGGCAACACCTTCCCCCGACCAACAAGCTGAGGGAT<br>AAGATCGGATTCATC |
| 180 | 86 | ATGAAGAACCTGAGATACAAAATCAACGCCTACAGAATCAAAAAAGACTATATTCCCAAGGAAGTTTATAGA<br>TACAGGATCCGCTCCTTCATAGAGAACATTAACATATATAGGTTCGTCGGTTTTTACGGAGGCGTGGCCCTC<br>AATCAATCTGAGTTTATCCTTCCGTACCCGGTCGAAAATCTCGTCCTGGAATACGACGGAAAAGATGTAAAG<br>CTTGAGCATATCGACACACTGAACCTGGAGGACATCGAGAATAAGGACAAGGAGAAAGCCGAGAAGCTGGTG<br>AGGGGATACCTGACCAGCATATACAAGTTGAAACCCATACTCTACAAGATCCTGCGGGACGTTCGAGAGAGC<br>AAGATCATTAACGATATCAGAGTGGATCCTATACCCGACTTTACAGTAAAAAGGCACAATAACGAATACTAC<br>CTTGTCATCGATTTTAACCACACCGCGACCGTGTTGAAAAATCTTTGGGACTTCGTGGGAAGGGACAAGCTG<br>AAACTCGAGGATTATATCGGTAAGAAAATCATATTCAAGCCCAACCCGAAGAAGAGGTATACTATAAAGAGC<br>ATTGAAAAGCAGAACAAGAAGGACATTGATGACATTGTCGAGCACATCATCGAGTACTACAAGTGGACGAG<br>GAGGAAATTAAGAGCACCTTCGGCGAAATCGACTATACTCAGCCCATCATCCATTGCGAGGGCATCCCCTAC<br>CCGTTCGCACCGCAATTTTGCAATATCGTATTTACCATGGAAGACTTGGATGAGAATACCCTCAAGGACCTG<br>CAGAGCTACTGGAGGTTGCCCAACGAGATCAAAGGCAACATTATCAATCAGATCGCTAAAAAACTGCGATTT<br>GTGGAGAACAGAGCCAATCGAATTGGAATTCATTAAGTTCAATAACACCCCCCTTATCGTGAAGGACGAAAAT<br>GGCAAACCAACAAAGATATACACCACCAATCGCCTCTTCCGATGGAATTACGATAGTAAATCCAAACTGTAC<br>TTGCCCTACGACATCCCTGACATAATCAAGAACAAAACACTGACAACGTTTGTGCTGATCGACGAGAATCTC<br>AAAAAACGTGAGTGGTAAGATCAAGAGAAAGGTCTACCAAATGTTCAAGAATTACAATAAGATCGCCAGCAAG<br>ACTGAGCTCCCGAAATTTGACTTCGCCAATAAATGGAAATACTTCTCTAACAACAACATCAGGGACGTGATC<br>CGAAAGATTAAGGATGAGTTCAACGAGGAGCTTGGCTTCGCGCTCATTATCGGCAACCGATCTATGAAACAT<br>GATTATTACGAGACCCTGAAGATGCAATTGTTCAACCTGAATATCATCTCCCAAAACATTCTCTGGGAGAAT<br>TGGTCAAAAGACGATAATAACTTCATGACAAACAACCTGCTCATACAAATTATGGGCAAACTCGGAATTAAG<br>TACTTCGCACTGGACGCAAAAGTGAACTATGACTACATCATGGGGGTTGGACAGCGGCCTGGGCGCATTCAAA<br>AGCACAGAGTGTCCGGGTGTACGTGATCTATGACAGCGAAGGGAAGATCCGACGGATTCAACCAATTGAC<br>GTGCCCAGCCCTGGGGAAAGGATCCCCATTCACCTGGTAGTGGAGTTCCTGGAGACCAAGACCGACATCAAT<br>ATGGAAAACAAAAACATCCTGTTCCTTCGAGACGGCTTTGTGCAGAATAGTGAGAGGGAGGAGTTGAAGAAA<br>CTGAGCAAAGAGCTGAATAGTAACATCGAAGTGATCTCAATCCGCAAGAATAACAAGTATAAAGTCTTTACC<br>AGCGACTACGGTATCGGCTCCATTTTTGGCAATGATGGCATATTCCTGCCACATAAAACTACATTCGGAAGC<br>AACCCGGTGAAGCTCAGCACCTGGCTGCGCTTTAACTCCGGGAATGAGGAAAAATTGAAGATAAATGAGTCT<br>ATAATGCAACTTTTGTACGACCTTACCAAAATGAACTACAGCGCTCTGTACGGGGAGGGTAGGAACCTTCGC<br>ATCCCGGCACCGATTCACTACGCCGACAAGTTTGTGAAGGCCCTTGGAAAGAACTGGAAAATAGACGAAGAG<br>TTGCTGAAGCATGGCTTCCTCTACTTCATC |
| 181 | 82 | ATGAGTCAAGACTCTAGGAGCACCGAGGTGGAGAGGCAGGCCGAAATACAACCTGGTACCTACCTGTTGAAC<br>GGCCGGGGGAAATTCAGTTGGATGAGGTTGACGCATTCCAGTACGACCTCAAGGTGAGTGGAGGCGTGGAG<br>CAGTATTGGGATCGGGAACAATTCACCAGCTCTGCAGCCTACTACCTGGACCAGGAACACGGGAGCCCTGTC<br>GCTGAGATAGGCAAAATGAACGTGCTCAGCAAGACGGATTTGTCTAGATCAGTTAGAGTGTGGCAGAGAAAC<br>GTGACTCCCATCAATAGGCAGAGCGTTACACTGACCGCAGCCCAACCCGAGGACCGAGAAAAGATCAAATCA<br>TTCGTGCAAAGCTGCTTCAAGAGGGCAGTGCCGACCGAAAAATACAGCTTTCGCTTTCTCAACAAGATTGTC<br>AGGGATGAGCCCGAGTTCACCACCGGCAGCGAAGGCTTTTCTGCACATCCGAAGCACGACGTTAAGATACAG<br>GTCACCGCTGATGGCAATGTGCTTGTGCACGTGGATAGCGGGTTCAGCATCAGGAGCAACAGCACCCTGGAC<br>GAAATCTACTCTGAACAGGATAACCCTTACGGTAAGCGCGTTGCCCACGACCCCGAGAGGTATGGTACCCAG<br>GGCCAAGGCACCCTTCGCGGTTGGAGCGACTATCGGTACACAGACCATATTAGCGATGCGGGTAGCTCTGTG<br>AACGAAATGCACAAAGGGGTGGCGGACGAAGAATGGCGGCAACGACTCGCAGAGGAGAATCCCCGACTTCTG<br>AAAGTGGAGTATGGCAACAAAACTAGGAGGCAAGCCCCCCATTTCCTGAGGCTCTCACCGCGGATCGAGCAG<br>GTGCAGGATCAGGATCGCGAGTTCTATAGCAGGTTTAACAGCCGGAGCGCGATGATGCCCGACGAAAGATTT<br>GAACTGTCTAAAGAGTTCCTGCAGACGTGAGCCGCTTGCCGGTATTGGACATGGAACTCGAGCCGGGTCCG<br>GTGAACAGCAGTTACGAGTTGCTGGAAATGCGAGAGGAAAACAGGCTGGTTTTTGGAGGGAAGCAGAGGGCT<br>AGAGACCCGGGCAGCGGGCTTAGAGAGAATGGGGTGTATCAAAGTCCCAGTCAGTACGGCTGCGGTGTTG<br>ACCCCCGAACGATGGGAGAGAAGGCGAGCGAGCTGATCCCCCTGATTGTGTCCGACCCTGAACGATCTGAGC<br>GCATCAGCAGGAGTTCGAGCATATGGATACGAATTGGGGGACGTCAGCAATTACACACCCGTGGTTCAGGAC<br>CTCCACGAGGAGACGGACGCTGTGCTCGCCGTGGTCCCCAATAAGGGTGTGGCCGAGGATTTTGGGATAGAC<br>GATCCATACAAGGAGCTGAAAAGAACCCTCCTGCGGAAAGGGATACCCACCCAAATGATGCAAAAGTCCACG<br>GTCGATGAAATCGTGGGTCAAAAGGCGGGAATCGGCAATGACAAGTTTCTGAACGCACTTAGTGCAGTCGTG |

TABLE 18-continued

Argonaute and helicase DNA sequences

| SEQ ID NO | Argonaute # | Sequence |
|---|---|---|
| | | GCCAAAGTGGGCGGTACCCCATGGCAGATCGATAGCCTCCCCGGGAAAACCGACGCCTTCATGGGCTTGGAC<br>GTAACTTACGACGAGAGTAGCGAGCAGCACGCAGGCGCCAGTGCAAGCGTAGTACTCGCGGATGGGACGACT<br>TTCGCAGCCGAGAGCACCACCCAGCAAGGTGGCGAGAAGTTCAGTGCACGGCATGTAGAACAGTTCGTGAGG<br>GACCTCGTCTTCGACTTTGCGGGGGAACAGGGCCGAGACATCGACAGACTGTGCATAATGAGAGATGGGAAG<br>ATCAGCGAGGATATTGACGCCGTAAGAGAGGGACTCAGTGGTATTGAGGCGGAGATCGACATAGTTGGCATA<br>CGAAAATCCGGGCAACCTCGCATAGCTGAGTTTGACGGTACTCGGTTTCGGATCGCCGAAAAGGGCGTGGGC<br>TTTGTGGACGCCGACAGAAGCCAGTCTATCATCCATGCATTCGGCAAACCCGAAATCCACGACGACAATCCT<br>GTGGGCACCCCACGAACCTTTCGACTGACCAAGGACTCTGGTCCCACAGATGTGGAGACCCTGACCCGACAG<br>GCATACTGGTTGTCCGAGATCCATTTTGGAAGCCCCGTTAGGTCCCCTAGGCTCCCCGTGCCAATAGAGTAC<br>GCAGACATGGCTGCTGAGTATGTTCGGGAGGAGTACGTCTCACCAGGGACTGTAATAGAAGGGCCAGCATAC<br>ATC |
| 182 | 8 | CTCCCCATCGTCCTGAACGCCTTCCCACTTAAAGTACCCGAACTGGAGCTGGAAGTTAGGCAAATACCGTAC<br>GATAAAGAGACGCTTGACGGCCTCAGGGCTGCGCACAAGGCCACCCACGCTTTCCGCAGGCAGGGCGACAAC<br>ATACTGATTTTTTCCGGTGATGGCACATTTCCCGCGTCTGGGACGCCTCAAACTATTGCACTGAAGGACAAT<br>TTCGGCGTGTTCTACAGCCTCGTGAAGGATGGTCTTATCCGCCACCTTGCGGGGCTCGGGAGGAATCCCAGC<br>GGGTTCAACCCCATAGAGTTGGTGTCCGCAAAACCCGAAGACAACCTGCTGGTCCCCATACTCGGCGATGCG<br>TATCCTTTTAAGGTGTGCGCGAAATACAGCATTGACACCAGAACCGTGCTGGGGCACCCATGTCTGGTGATC<br>GATTGCACGACCAGGAGGGTGTTGAAGGAAAATGGCTTGTTCTTTTTGAACGCTGGGTTCGACCTCGCGGGC<br>AGGTACGTGGTGACGGAGCAAGATGACGGGTACAGGAAATTGCTCGGCAGCGTGAGCGGCTGTAAGGGTGAA<br>ACGCTGTACGTGACTAGGCCCGATGGCCAAGTGGTGCAGGCCGAGGCTAAAAACGTGTACCTGGAGGCATCC<br>CGCACAAATTTCGACGACTATATTCTGCACACCCACAGGGCTCAGAAGGACGCGATCGTTGAACGAATCAGA<br>CAGTCCGTTTCCGTGTTTAATGGGGGCGAAAATAAGAAAGCCCGAATCGACACGCTGAAGAAGTATATCCAG<br>TCCAAAACCATTCCCTTGATCGACGGCACCAGGATTGAGATCCAAGATTCCCCTAACATACAGAAAGACTGC<br>GGCCAGATGCAAAAACCGGTATTCGTCTTTAACGACAACGGCGAGGCGGACTGGGCGGAGAAGGGGCTGACC<br>CAATCTGGGCCGTACACCAAGAGGACCTTCGACAGGAATGACCCCTCCATTTGCGTGATCTGCGCCCAACAT<br>GACAAGGGACGCGTTGAGCAGTTCGTCAGGAAGTTGCTTAAGGGCATTCCAAACTCCAAATACTTCAGCAAC<br>GGTCTCGAGGGGAAGTTTACCTGGGCACTGACAGGGTAGAAGTGTTCGCGACCGCTACTGACAGCGTAGAC<br>GCCTACAAGAACGCTATTGAAGCCGCAATACGGAAGAAGGCCGACGACGGCGGCAGGTGGGACCTGGCCCTG<br>GTTCAAGTGAGGCAGAGCTTTAAGGAAGTTGAAAGTGACCGAGAACCCCTACTACCTTGGCAAAGTCTGTTC<br>TTCCTCCACCAGGTGCCCGTCCAGGACTTTACCATTGAGCTGTTGGCTCAGTCCGACTACTCCCTCGGCTAC<br>TCTCTGAATAACATGGCCCTTGCATGCTACGCGAAGATGGGCGGTGTGCCCTGGCTGCTTAAATCTTCACCC<br>ACCCTCAGCCATGAGCTTGTGATAGGCATCGGCTCCGCCAACATCGGCCAGGAGAGAGGAGCTGATAATCAG<br>AGAATTATGGGCATCACCACTGTGTTCAGCGGAGACGGCAGCTATATCGTGAGCAATACATCTAAGGCTGTT<br>GTCCCCGAAGCTTACTGCGAGGCCCTTACCGCCGTACTTGGCGAAACCATCGAAAAGATTCAGAAGAGGATG<br>AACTGGCAGAAGGGCGATACCATCAGATTGATCTTCCACGCTCAGGTCAAGAAATTCAACAAGGAGGAAATC<br>GAAGCGGTCAGAGCCGTCATTGAGAAATATCGGGAATACCAGATCGAGTACACTTTTCTGAAGATAAGCGAA<br>AACCACGGGCTTCACATGTTCGATAGTGCAACCGCAGGGGTGCAAAAGGGCCGACTTGCCCCTCCGAGGGGG<br>AAGACGTTCAAGCTGAGCAAACATGAGATGCTGGTTTATCTGATAGGGCAGAGGGAGCTGCGGCAAGACACC<br>GATGGTCATCCCAGGGGCGTCATCCTTGATGTTCACAAGGACAGTACATTCAAAGACATCACCTACCTTTCA<br>GCCCAGCTCTACTCATTTGCCAGCCACAGCTGGCGCTCTTACTTTCCCAACCCTATGCCAGTAACCATTTCA<br>TACAGCGATCTGATCGCTCGAAACCTTGGTTGGCTGAACCAACTGCCCGGGTGGAACGACTCCGTGATGATC<br>GGAAAGATCGGGCAAAGCCAGTGGTTCCTG |
| 183 | 39 | ATGAAAGAGTTTAACGTCATTACCGAGTTCAAGAACGGCATAAACAGCAAATCTATTGAGATCTACATCTAC<br>AAAATGATGGTCCGAGATTTCGAGAAGCGACACAATGAAAATTACGACGTGGTGAAGGAGCTGATTAACCTT<br>AACAACAACTCCACCATAGTGTTCTACGAGCAGTACATCGCCTCCTTTAAGGAGATTGAGAAATGGGGGAAC<br>GAGCAATACATAAATGTGGAGAAGAGGGCTATCAACCTGGAGTCCAACGAGAAGAAAATTCTGGAGAGGCTC<br>CTGCTGAAGGAAATCAAAAATAACATAGACAATAACAAGTACAAGGTCGTCAAGGACAGCATATACATCAAT<br>AAGCCAGTGTACAACGAGAAGGGCATCAAAATTGACAGGTATTTCAATCTGGACATAAACGTTGAGTCAAAC<br>GGAGACATTATCATCGGGTTTGACATCTCCCATAACTTCGAGTATATCAACACTCTGGAGTATGAAATAAAG<br>AACAATAATATCAAGATTGGGGACCGGGTAAAGGACTACTTCTACAACCTGACCTATGAGTACGTGGGCATC<br>GCCCCCTTTACTATCTCCGAGGAAAACGAGTACATTGGCTGCTCAATCGTCGACTATTATGAGAACAAGAAC<br>CAGAGCTATATTGTGAATAAACTGCCTAAAGACATGAAGGCCATCCTGGTAAAGAATAATAAGAACTCTATA<br>TTTCCCTACATCCCGAGCAGGCTTAAAAAGGTGTGCAGATTCGAAAACCTTCCCCAGAACGTGCTGAGGGAC<br>TTTAACACGAGGGTGAAGCAGAAGACAAACGAAAAAATGCAGTTCATGGTTGACGAAGTGATCAACATCGTG<br>AAGAATTCCGAGCATATCGACGTCAAAAAGAAAAACATGATGTGCGATAACATTGGGTACAAGATCGAGGAC<br>CTGCAACAGCCCGACCTGCTCTTCGGTAACGCCCAGGGCCCAGAGGTACCCCCTCTATGGTCTCAAAAACTTC<br>GGGGTGTACGAAAACAAGCGGATAGAGATCAAATACTTCATAGACCCCATCCTCGCCAAGTCAAAGATGAAC<br>TTGGAGAAAATCTCCAAATTTTGTGACGAGCTGGAACAGTTTAGCAGCAAGCTGGGCGTGGGGCTCAACCGG<br>GTTAAGCTGAACAACATAGTTAATTTCAAAGAAATCCGCATGGACAATGAGGACATTTTCAGCTACGAGATA<br>AGAAAGATAGTGAGCAACTATAATGAACTACCATCGTAATCCTGAGCGAGGAGAACCTGAATAAGTACTAC<br>AACATCATTAAGAAAACATTCAGCGGCGGAAACGAGGTGCCCACCCAGTGCATCGGTTTCAATACGCTGAGC<br>TACACGGAAAAAAACAAAGATTCTATCTTCCTGAACATTCTGCTGGGGGTTTACGCCAAGAGTGGCATCCAG<br>CCCTGGATCCTGAATGAGAAGTTGAACAGTGACTGCTTTATCGGCCTGGACGTGTCTAGGGAGAATAAGGTC<br>AATAAAGCGGGAGTCATCCAGGTGGTCGGGAAGACGGCAGGGTGCTCAAAACTAAGGTGATCAGCAGCAGC<br>CAAAGCGGAGAAGATCAAGTTGGAGACCCTCAGGGAGATCGTGTTTGAGGCAATCAACAGTTACGAGAAT<br>ACGTACCGGTGCAAACCCAAACACATTACTTTCCACCGCGATGAATCAACCGCGAGGAACTGGAGAACTTG<br>AAGAACACCATGACCAACCTCGGTGTTGAGTTCGACTACATCGAAATTACCAAAGGCATTAACAGGAGGATC<br>GCCACTATCAGCGAGGTGAGGAATGGAAGACGATTATGGGAGGTGCTACTATAAGGACAACAACAGCGTAC<br>GTGTGTACCACCAAGCCTTACGAGGGAATCGGCATGGCCAAGCCCATCCGAATCAGGAGGGTGTTCGGCACG<br>CTCGACATAGAAAAGATTGTCGAAGACGCCTACAAACTGACCTTTATGCACGTTGGCGCAATTAACAAAATC<br>AGGCTTCCCATTACTACGTACTACGCAGACCTGAGCTCCACTTACGGCAATCGGGATCTTATCCCCACAAAC<br>ATCGACACTAACTGTCTGTACTTTATA |

TABLE 18-continued

Argonaute and helicase DNA sequences

| SEQ ID NO | Argonaute # | Sequence |
|---|---|---|
| 184 | 89 | ATGTCTGTGGACGCTATGATCAGGAGTATCGGGGTCGCACGGGACCGCCCGCTTCTCGTTTTCCTCGGGGCA<br>GGTGCCTCAATGAGCAGTGGTATGCCGTCCGCCACTCAATGTATCTGGGAGTGGAAACGAGAAATCTTCTTG<br>ACAAACAACCCCGACGTTGAGAAGACCCAGTTCTCCGAGCTGAGCCTTCCCAGCGTCAGATTGCGCATCCAA<br>GCATGGCTGGATCGGCAACGACGCTATCCCGCTCTTGATCATCCCGACGAGTATTCTACCTACATAGGTGAG<br>TGCTTTGCACGCTCTGACGACCGCAGAATCTACTTCGAGAAGTGGGTCAAACGCTGTAGTCCGCACCTTGGA<br>TACCAACTGCTTGCCGAATTGGCACGGCAGGGGCTTGTGGCCAGCGTTTGGACTACTAATTTCGATGCCTTG<br>GCGGCTCGCGCAGCTACGTCCATCAATCTCACTGCAATCGAGATTGGAATTGATTCACAGCAAAGACTGTAC<br>CGGGCGCCGGGCGAGGCGGAACTGGCGTGTGTGAGTCTGCATGGAGATTATCGGTATGATCCTTTGAAAAAC<br>ACCGCTCCAGAACTCATAAAACAAGAGAAGGAGCTCAGAGAGTCACTTGTCCAAGCGATGAGAACTCACACA<br>GTCCTGGTTTGCGGCTATAGTGGTCGGGATGAGAGTGTCATGGCAGCGTTTTCCGATGCCTATGACGCAGCT<br>CATTTTAAGGGTCATCACCCCCTCTTCTGGACACAGTACGGCGATTATCCCGCCAGTGAGCCCGTAGCTGGA<br>CTTCTTGCTTCACCGCTGGATCAGGAACCTGCGAAGTTCCACGTGCCTGGGGCATCATTCGATGATCTTATG<br>CGCAGGATAGCACTCCACGTGAGTGACGGTGAAGCGCGCGAGCGGGTGCGGAAGATTCTTGAGAACTTCAAG<br>ACGGCACCAGTTAACCAGAAGCTCCCCTTTGCCTTGCCTAGTCTTCCTGTGACGGGTCTCGTCAAGTCAAAC<br>GCCATTCCGTTGATACCGCCTGGAGAGCTTATAGAATTTGATCTTGTCCGGTGGCCGCCGTCCGGTGAAGTT<br>TGGAGCACGCTCCGGGAAATAGGGGATAGACACGGATTCGTAGCTGCCCCTTTTCGCGGGAAGGTGTATGCT<br>CTGGCTACGATAGAGCAACTGACACAAGCCTTCGCGGACAATGTAAAGGATGGCGCGTTCAACAGGGTGCCG<br>CTGAATAATGATGACCTCCGCTACGAGGACGGAACCGCCAATCAGCTGATGCGACGCGCTACTGTTCTGGCT<br>TTGGCTGGGAAAGCTGGATGCGCGAACGATGGGGATGCCATTGTGTGGGACACGTCTCGCTCAAAAACCGAA<br>AGATTGGATAGGCAACTTTGGACTGTATACGATGCAGTACTTCTGCAGATTCGGCCGCTGGGAACTAAGCTC<br>GCGCTCGTACTTAAGCCTACGCTGCGGGTTACGGATTCAACTGGCGAGGTAGCCCCGAAAGAAATTGAACGG<br>GCAGTCAAGGTGCGCGTATTGGGATACCAGCATAACAAAGAGTTCAACCAGGCGACCGACTTTTGGAGGAAA<br>AGGCTCCTGCCCTCAAGAGATCTCCTTGTCAGATTTCCTGATCTGGATGGTGGAATGACTTTCACGATTTCA<br>GGTCGGCCAATATTCGCCCGGCTCACCGACGAAAGGACTGAAACTGTCACACTGAACGATGCCCAAGAGCGA<br>TCAGCATCTCAAGTGGGGTTGCAGCTTGCAGAGCCTAAACTGGTGTTTGCACGCACTGTAGGTACGGGTCCC<br>GCAACGGACACCCTCCCGGTTAGAGGATTGCTGCAAAATAGACCTTTCGATGCTAATCTGACAGACTTGGGC<br>ATCGCGACGAACCTGAGGATCGCGGTTATTGCGCCCGCTCGGGACGCCAGAAGGGTACATGACTATCTTGGG<br>CAGCTGCATCAGCCTATAGATCTACAAAGTGGGATGCGGACTATCTGATGAGGTTTCCCGGCTTCAGCTCG<br>GCTTTTAAATGCCCTTTGGACATTCCGCAGCCGGGCCAGGCAGCTTTTGTAACACTTGACGAGCCACACGAT<br>GAGAGTCCTCAATCAGCGCGGACCCTTGCAGGCCGAATCACAGCGGCACTGTCTGCATTGAGGGCGACGGAG<br>AATCCCTCTGTTACAATAATATATATTCCGGCGCGCTGGCACGCGCTGCGAGCATTCGATCTCGAATCAGAG<br>CAATTCAATCTTCATGACTTTGTTAAGGCCGCCGCAATTCCAGCGGGCTGTTCCACACAGTTTCTGGAGGAG<br>TCAACTCTTGCAAATGGCCAACAGTGCAGAGTGCGATGGTGGCCTTAGCCTCGCTGTTTACGTAAAGGCAATG<br>CGCACCCCGTGGGCTTTGACGGGACTCGATAGGGACTCTGCCTTTGTAGGGCTGGGCTTCTCTGTAAGACGA<br>AAGATCGATGGCGAAGGTCACGTCGCGTTGGGTTGTTCTCATCTTTATAGCCCAAATGGTCATGGTTTGCAG<br>TTCCGCTTGAGTAAGATTGATAATCCGATAATGCTGCGAAAAAATCCTTTTATGTCCTTTGACGACGCTAGA<br>AAGTTGGCGAAGGCATCAGGGAATTGTTTTTTGACGCCCACCTCCGGCTGCCGAATCGCGTAGTTGTTCAT<br>AAACAGACCCCGTTTCTTAAAGAGGAGCGGGAAGGGCTCCAAGCAGGTCTCGAGGGAGTCGCGTGTGTGGAA<br>CTCTTGCAAATTTTTGTAGACGATACGTTGCGATATGTGGCTAGTCGACCAATGCCGAATGGAGATTTCGAA<br>ATCCATGGCTATCCTATCCGAAGGGGCACCACAGTAGTGGTCGACGACCAGACCGCATTGTTGGGGTACAC<br>GGCACATCAACCGCGCTCAACCCGCGGCAGAGCTATTTTCAGGGCAAACGCCGCATACCGGCCCCCCCTTGTG<br>ATGAGGCGGCACGCGGGGACGTCTGATCTGATGATGTTGGCGGACGAAATATTGGGACTGTCCAAAATGAAT<br>TTTAACAGTTTTGACCTGTATGGCCAACTCCCGGCAACCATCGAAACGAGCCAAAGAGTCGCGAGGATAGGC<br>GCTCTGCTGGACCGCTATACGGAACGGTCATACGATTATCGACTCTTTATG |
| 185 | 29 | ATGCCACACACCTCCCTGCTGTTGAACTTTCTGCCCGTCTCTCTTAGCGGCGACACACGCATCCATGTCGGC<br>TACCGGCCATATAACGAGGATGTGCTGCGGGAACTGAGGGAGGAGTTCGGCGAAAGCCACGTGTTTAAAGG<br>GACTACCAGGAGGACACGATAAGCGAGATACCGGTCATCCCCGGAGCCGAGCCCCTTAGCGACAAATCTACT<br>GGCGTGGATCTTGCCGAAGCGCGATGGCTGTGGAAACCACTTCTGAACGCTGCATTGCTTCGCCTCTTCAG<br>GGAAGCAGAGAGATCACCTCTGATTATCCAGTCAGCGTGCTTGGTAACCCCAAGAACAACTTCATCAGCCAT<br>GCCAATCTCCCCGACTGGGTGAGAATCCTGCCCCTTCTGGAATTCGAGAGCCGAACCCTGTTCGGTGGTAAA<br>TCCGGTCCGCAGTTTGGGCTTGTTTGCAACGCCCGAACTAGGCACCAGGTCCTGGCAGGCTGCGACCATCTC<br>ATTGAAAGAGGTATAAGTCCCATTGGCCGCTATGTTCAGATCGACCAGCCACAAAGAGACTCCAGACTTGCG<br>CCACGCGGTCTGACTGTTGGTAAGGTGAGCTCTATCGATGGGGACACGTTGATCCTGGAGGATCACCGAAAG<br>GGCTACGAGCGCGTGAAGGCAAGCGACGCTCGCCTTACCGGCAATGGGCGGACTTCGACTGGTGCGTGAAC<br>GCGCTGTTGCCTGGACAAGGTCAAGCAACGCTGAGCAGGGCGTGGGACGCCATGAGCGCCCTGAATCAGGGA<br>CCCGCCGCTTGCAAATGATCAATCAGACAGCTGAATATCTGAGGACCGTGAACCTTGAGGCGGTTCCTGGG<br>GTAGCATTTGAGATCGGCGAGTGGCTGAGTTCTACCGATGCTCAGTTTCCTGTGACCGAGACCATCGACCGC<br>CCTACCCTCGTGTTTCATCCCTCCGGCCGACCCAACGACACTTGGAACGAGAGGGGGATAAAGGACAATGGC<br>CCGCACGACCAGAGGACATTCACCCCCAAACAGTTGAACATCGCCGTGATTTGCCAGGGCAGATTTGAGGGA<br>CAGGTAGACAGATTCGTGGGCAAGCTGCTCGATGGCATCCCGGACTTTCAGTTGAGGAACGGCAGGAAGCCC<br>TACGACGACGGTTTCCTTAGCCGGTTTAGGCTGGAGAGGGCCAACGTGCAAACCTTTCAGGCTAACAGTGCG<br>TCCCGCGAGGCTTACGAAGCAGCGTGTGAGGACGCTCTGAAACATGCCGCTGATAACGGCTTTGGCTGGGAT<br>CTGGCTATCGTTCAAATCGAGGAGGATTTCAAGGCGCTGCCTGGGCCCAAAATCCCTACTACGCCACCAAG<br>GCAATGCTCCTCCGGAACAACGTAGCCGTGCAGAACATCAGGATCGAAACAATGAGTGAGCCTGACAAAAGC<br>TTGGTCTACACTATGAACCAGGTTTCTCTTGCTTGCTACGCAAAGCTGGGTGGTAGACCTTGGCTCCTCGGT<br>GCCCAACAGAGTGTCGCGCATGAGTTGGTGATTGGACTGGGCAGTCACACCGAGCAACAAAGCAGGTTTGAT<br>CAGTCCGTGCGATACGTAGGCATCACCACCGTATTTTCCAGCGATGGAGGCTACATCTGAGCGAGCGAACC<br>GGAGTAGTGCCCTTTGAAGATTACGCCAAGGAGCTGACAGACACCCTCACTAGGACCATAGAGAGGGTGCGA<br>AGGGAAGACAATTGGAAGAACACTGATAGAGTTCGCCTGGTGTTCCATGCTTTTAAGCAGATTAAGGACATC<br>GAGGCCGAGGCCATCAAACAGGCAGTGGAATCTCTTGATCTGGAGAACGTTGTGTTCGCATTCGTCCATGTG<br>GCCGAGCACCACCCTTATTTGATCTTGACCAAAACCAAGAGGGATTGCCCCACTGGGAAAAGAACAGGAGC<br>AAGCGCAAAGGCGTCTTGGGACCCAGCAGAGGCGTGCATATAAAGTTGGCGGACAGCGAATCCCTTGTGGTA<br>TTTGCTGGTGCTAGCGAGTTGAAGCAGGCGGCACACGGTATGCCTCGGGCCTGTCTGCTGAAGCTGCACAGA<br>AACAGCACCTTCAGGGATATGACCTATCTGGCGAGACAAGCCTTCGATTTCACCGCCCACAGCTGGAGGGTG |

TABLE 18-continued

Argonaute and helicase DNA sequences

| SEQ ID NO | Argonaute # | Sequence |
|---|---|---|
| | | ATGACCCCTGAACCATTTCCGATCACAATAAAGTACAGCGACTTGATAGCAGAGCGATTGGCGGGTCTCAAA<br>CAAATAGAGACCTGGGACGACGATGCCGTGAGGTTTAGAAATATTGGCAAAGCCCCCTGGTTTCTG |
| 186 | 52 | ATGTCCGGCCTTTTCCTGAACTTTTACCAGGTAGACATCCCCACCCAAATCCGTACCGATCCACAGCGTAGAG<br>TATAGCCATTACAGTTCAAAGGAGGCCTTTATCGCGTTGAAAGAAAACTTCCCCTACTTTAGCTTCTACCGG<br>GATGACGACCGAATACTGATCTGGAAGAAAGACAAGGATGCCGAGCTCCCCGAGAAGAACTCATTGATTGAA<br>ATTGATTTCACCGAGAAAGCGAAGGTCCTCAGCAAAATACTCGAGAGGGCCATCATTGACTTCATCGAGCCA<br>AAGGGCTACAAGATATTCAAGAACAAGTACAGCAACAGCTGGGAAATAGTGAGCATGAAGGACATCCTGAAT<br>GGTGGGATCGAGGGACTCAGCATCAATCGATCGTGCATTTTTCCCCCTGCTTCTTCTTCAAGGAGAACAAA<br>CTCATGCTGGGTTTCAGCCTTAGCACAAGCCTCAAAAACGTGTTTACCTGGAATAAGGCGGACTTCGAAAGG<br>TACGGCTTTGACATCAAGGGCCTTAAAGGAGACGAAGAGCGGATTTTTGCCAACAAGCAATCCCTTAAGAGG<br>TTCCTGGAGACCAAGGGCGCAGTTGCAATGTATGACCAAATTATCGCAAAGGAAAACAAGAACGCGAAAATG<br>TTTAGCATCATCGACGGCTTCTATCGGTGGCTGGAGAGGAACAAGACTGAAATCCAGCTTCCATTCGGACTG<br>AAGATAAATTCAGTGTCTAAAAAGTACCTGCCGTTCGAGGATGAGCTGATCAAGAGCGAGATCATCCCTAAG<br>CCCCAAAGGTATTTCTATAGCAATAGGAAGAACACCCAGAGCCTGCGGTACTATGACGAGATGGTGAAGACT<br>TATCAGCCCTACTCTCTGGAGCTCTACCAAAACAAACAGATCAACATCGGAATCATCTGCCCCAGCGAGTAC<br>CAGGGAGAGACGAGGGGTTCATAAAGAAGATCGAACTGAAGCTCAAGGAAGTATTCCATTTCAACAGCCTG<br>ATCTTTCACTTCAAGACCATTACGAACAAGGACCTCGCGTCCTATAAGGAGGTTTTGTACGACGATGAACTG<br>CTGAAGTGCGACCTGATTTACGTCATCGTGAATGAGGCCCAGGAGAAACTCTCACCTAATAACTCCCCTTAC<br>TACGTGTGCAAGGCCAAGTTTATAGGCAATGGCATACCTACGCAAGACATTCAGATTGAGACCATCCGGCAG<br>AACTTGAATGCGTTCACAATGACGAACATCTCACTTAACAGCTACGCCAAACTGGGAGGCACCGCGTGGACC<br>ATCGAGAAGGAAGACAAACTTAAGGACGAGCTGGTCATTGCATCGGCTCCACCCTGTCAGAAAACGGCCAG<br>TTCGTGCTCGGTATCGCACAAATCTTCCATAATGACGGGCGCTACATGGCGGGTGACTGCAGCCCCCTTTCT<br>ACCTTCTCCAACTACGCGAAGAACCTGGAGGATCACCTGTACAGACCCTGAAGCCCCTGGTGGAGGAGATG<br>AGCAAAAGCGGCACCTTCCGGCTGATTTTCCACTTGTTTAAAAGTGCCTCTGAGGAGTACGAGATACGCGCG<br>ATCAACGGCCTGCAGAAGAGGCTGGCGAACTACAATTTCGAATTTGCACTCGTTCACCTGGCCTATGGACAC<br>AACTTCCGACTCTACTACAACGACGGCAACGGCGACATTAATCAGGGCACATATATACAACTGTCAAAACAC<br>AGCGCCCTGCTCCACTTCGTTAGCAAGTCAGACTTGCCCCTGAAAATCGACCTGGACAACGCGGTCTACTTTC<br>ACCAGCCTGCTTTTACATCGCCAAGCAGGTGTACTGGTTCAGCCATCTGAGTCATCGCAGCTATATGCCCAGT<br>AAGAGGACCGTGACCATCATGTATCCGTCAATCATGGCGAAGATGACCGAGGAGCTTAAGAAGGTGGAAGGA<br>TGGGACTACGAGCGCCTGAAAGCAGTAAGCGATAAGCTGTGGTTCATC |
| 187 | 60 | ATGAAAAGCAACTTCTTCCCCATCCAGTTCAACTTCGACGACTTCCATATCCAGAGGCTTCCCTACCAGAAG<br>GAGGTGCTGGACAAGCTTCGGCAACAACACAATGCGACCCATAGCTTTTTCCGCAGAGACGATTTTATCTAT<br>ATTAGCCCAGGGGTAGAGGCCGCAGCGAACCTGGGAGACGTAGTACGCCTCTATTACCAAGCACCCCGAG<br>GTCGTTGCTTCTCTTGTTAGGCACATATTCTTTAGGACAATCAAGGATAAGGTCCCCGGTCTGCTGCCAAGC<br>TTTCACCCATTCACCTTTCCCGCCAAACAGGACAAATACGATCTGGCCCTTGAACATGCTCCCCGAAGCGCCTG<br>CAGAATGTTATCACCTACAAGAGGATAACCGAGGTACAGCTTCGATTCAACGAGACCGAAGAGCAACCCCAG<br>TTCGTCGCCGTAGTTAACCACAGGTACCAGTGGACTATCGACCGAACTTGCGAGCAATTGGTAAACGAGGGT<br>CTGGACATCCTTGGCCTGGAGGTGAACTCTAGTACGAGCCCTGATTATTCAGACGGAGTTGTGGCACCAGAG<br>CTGACACTGTTGGGCAGGGTGATGGCCGTGAACGGGGATCACGACACAGTAGGGACCAACCAGGGTCCGACA<br>GAGTATGCCCTGTTCGAATTGACCTTGTTCAAGTCCAAGGAGAACATAGTGAACTACCTTGGATCTTTGGTG<br>GGCGAGGGTAAAGCCGAACAAATAGTCAACCATATCAAACAAGATGAAAGCAGAAGGCTGCAACCGGACGTT<br>GTGATGAGGGAGATCGAGGAAATGGGAGTGTGGCTGTCTAGGCTGGCCTACAGAAACTTTGACTCCTTTTGC<br>TTCACCATGGAACGAACAACGCTGTCAGCGGCCAAGCAGGTATCAGACTGGAGGAGCCAAAGCTGATATTT<br>GACGTCTCAGGTACGAACATACACGCTACCCCCACAACCGGGCTCAACACCTTCGGCCCCTATAGTAGAAGC<br>ACGAGTTTCGACGTTAACTCTCCGAAGATTCTGGTTGTGTTTCACCAGCGGAACGCAGGCCACTTCGCAGAG<br>TTTCTCGCACAGCTGAAGGCGGCATCGCTCAGCACGCATACTTTGCTAACGGGATGGTCAGGAAGTATGGT<br>CTCACGGCAATGGAGTACCGGATTGCCGAGATCACTGACTACACCGTGCCCCAATATCTTACCGCCATCAAT<br>AAGCTGCTTAGGGCGGAGAACGGAAGCTTTGACATCGCCATCGTGGAGACCTGTGAGGATTTCCGGAGGCTG<br>CCTCCCATGGATAATCCGTATTTTCAGGTTAAGAGTTTGTTGTACAGCCATGGAATCAGCACCCAATTCATC<br>AGAGCGGAAACCGCTCAGAAACCGATTTATTCAATAGATAGCATCGCGCTCCAAATGTACGCCAAATTGGGC<br>GGAACACCATGGACGGTGCCAATAGGGCCGAGCGTAGATCACAGAATTGGTGATAGGCATCGGTAGCTCCATA<br>TTGCGCAGCAACCAGTATGCAGGTGCAACCCAAGCTCGAATAGTGGGGATTTCTACCTTCTTCAGCGCCGAC<br>GGGAAGTACATAAGCAATAGAAAGACCCAGGACGTGCCTTACGATCAGTACTTCGATGAGCTCTTGCATAAC<br>CTTAAAGTCTCCATCGACGAGATTTCCAATAACTACAGCTGGAGCTCAGGCGACCGCATCAGGATCATATTC<br>CACATCTTCAAGCCCATAAAAACACATCGAGGCAGACGTCGTCGCAAGCCTGATGGAACAGTACCAGGAGTTC<br>GATATAAAGTTCGCTTTTGTGACCTTTAGCGAGTTCCACCCGTATGTGCTGTTTAATGAAAATGAAAGGGGG<br>GAATTTGATGCGTATAGGAAGGTTTACAAGGGCACCCATGTACCGTGGCGCGGTTACAATGTTCTGCTGGAT<br>CCTCGGTCATGCCTGGTCAGATGCTGGGACCCCATGAGATGAAGACCAGCCGGCACGGCCTTCTAGGCCC<br>GTCCTTGTGAGAATCCACCGCAGTTCTACGTTTGTAGACCTCGCGTACGTCGTGCAACAGGCCTTTAAGTTT<br>ACTAGGCTCTCATTCCGCACGTTCTACCCTGTGCATAGCCCTGTGACGCTGCTCTACAGTAATATGTTGGCC<br>CGACAGCTCAAGGACCTGAGGGGCATTCCGGGTTGGAACTACGATGTAGCTAGCAGGCAGTTGAGGCACAAG<br>AAATGGTTCCTG |
| 188 | 40 | ATGCAAGGCACTATATCCATAAACGAGGTGAGGATCCAGCTTAATACTATTAAGAATCTTTCAGTGTTCAAG<br>TGCAGCCTCAGCGGAATTAGCACCCGCCATAAGAACCAGATCGAGTTCATCCTTCGCAGCGAGCAAACCGA<br>GTTAGCATCTTTGAGGGTGAAGTGATCTTTGCGCTTCCCGTCGAACAGCAGAACCTCGAAAGAGATAAGCAG<br>GCTCTGTTCAGCTTCCTGGTCAAACAACAAAGGGATCTCAATCTGAAACAGCTGAGCCTGGTGCCCCTGAGG<br>GAGGTGCCCGAGCGCGTTATCGAGCGACTGACTTTCGCAATGGTTAGCTACTATGGCCATGAAGCAGGGCATC<br>TTCTCTATCTATGGTCATACATTTTTTCGCCCCACCCTTATGACGGATAGGCTTGCGCACAAGGCGGTGGAA<br>GTCACGACGTGCATCGAGGATGGCTTCCTCAAGTTTTATCTGGACCCGACGTACATTGCACTGACATGCATA<br>ACGGACACAGCACGCGAAAATAGGGAGAACCTGGAACTGGTCGGGCTCTGCTCTTTCCGCAACAAAAACCTT<br>TGTAGCCTTGTCAGGCCGGACGGCTCATGCAACTGCCTCATACCTGGTAAGTTGGGGTATTACGTCCAGGAG<br>ATGGGGATTAAGGACGTTGAGGATGATAGCAAGGACTTTCTGGCCAAACGGTTCAATAGCTGTCCCCGGTTT |

TABLE 18-continued

Argonaute and helicase DNA sequences

| SEQ ID NO | Argonaute # | Sequence |
|---|---|---|
| | | AGTGAGCACACGCGCTTTATACAAGTGAAGGCGAGTAAAAGAGGCACGAAGTACTCCCTGTTCCCTTCTTAC<br>GTAGTTTTTAGCAGGTTGTCCCGAATGGACCTGTCCGCTAAGCCAGATGTGCGGTCCAGTTATCGGAAGGCC<br>ACATTGATGGACTCTCACGAAAGGCTTAACTTGACCAACGACTGGATAAGACAAATTTTCATGATCGGGCAG<br>AAGGGCCTTCAAAATTGGGGTGTTATAAAGGTCAACCAGACCGAGATTCCCGTTGAAATTGTACTCACAATT<br>GCCCACGCCATCGCGCCCAAGACTTCTCAAGGCATCTATAAGGCTATATTCCTCCCGGACCAGCAAATTACG<br>AATGACAGCAATAACCCAACGCCTCAAACGCTGAGCGGGGGTTGGCTCTTCACGAATAGGGGTGCGTTCGAC<br>AGGAGGGATCCTAATAGGCCTTTTAAAGTAATCAGCCCCTACATCATCGTGCCCAACAATGAGCAAAGCATC<br>AGCTCTTGCCGCCAGCTGATCAACTACTTCAGCAACGGCAGGTACAAGGCCCGGTGCAAGGGTGACAGAGAC<br>TTTATTGGTATTTCATTGCCCGAAAACAAGGGCAAGTACAACACATCATTTGTCAATGCTTTCGAAGAGGAG<br>GACGGCCTGTATTTCGTTGAAGAGACGATACAGGGCTACCAGAAGGCGCTGCAAGACATTGTTAGAGACTGG<br>AATATCACGTCCAAGCGGGACATCAATAAACACGCTATAGTGATCATACCGGGCGAGAACGATATTGACGAC<br>AATCCTTTCTATTATCAACTGAAAAAGGCGTTCGTAGAGGAAGGGATTCCCAGCACCTTCATCACGTACGAG<br>ACTATGAACAAAATCAACGACCCCGACATCGCGTTCGGGCCAATCATGGACAGCCTGTGGTTGAACATTTAC<br>AGCAAAATGGGGGCAAACCGTGGCGCCTCGCTAATAGCCTCGGCAACGTGCACTGCTTTATCGGTATTGGG<br>TTTGGAATTAACCCCGAGACCACCGGAAACCACATATTCGCAGGGATCGCCCACATCTTCGACAACTACGGG<br>AGTTGGATAGACGTAGCGAGTGATTCCGCCAACCTCTCCCAAAACGATCTGAACTCATTCGAGGGCACGGAA<br>AAGTACACACAGGGGAGTGCTAGCTTTAAGATCAGTCAGAGCGTGTCCCAGTCCATTGTGTATAACGCATTG<br>AAGCTGTACCAACAGAAGCAAACTAAGACCCACGAAAACGCCACAAACATCGTCCTGCACAAACTGGGCCAG<br>ATCTACGAGTGTGAGGTCATCGGGTTCCTCGAAGGAATTCGCCAAGTGCTCGGGAGTCTGGGCGACTGCAAG<br>CTGGGATTGCTGCAAATTGAGCAGGAGCACCACCTGCGCCTCTATGGCGCAGCAGCCCAAACCGGCAAGGAG<br>AACAACACGATCTTTCGCGGTTCAGCACTTCAACTCAACCCGGAGAAGCTGGTTATCGCGTCCACTGGCCGC<br>TCTTACCGGCAGACGAGCTCCGGGCTGTTTATGAATTATCCGGGCATCGGCACCCCCCAGCCGCTCCTGTTG<br>ACTTCTATCGTACCGAATCAGCAGATCCTGCAGAAGTACGGCTGTAACGCAAACCAATTCTACTCAAGCGAG<br>GACCTGGCGAAACATGCAATGGCCCTGACGCAACTTCACTGGGGGTCACTGAAGGATAATGTAAGATTGCCG<br>ATTACCACGCTTTACGCGCAAAAGGTCGCCGACTTGATTAGCAAGACCAACATGCGGATCAATCCAGGCTTG<br>GGCTACTTCCGACCCTGGTTTCTT |
| 189 | 58 | GTTCCAGTGTACCTTAATCGGTTCCTGCTGGACCACCTCACATCACCCTTGTCCTTGCCGGCGTTTCGGGTC<br>GAACTGGACCCTCCCCCTTCCAAAGATGAAGTGCACCCGCTCCTGGCTCTCGTCGGTCGGGAAGCGGGAGGG<br>CTCGTGAGGTTCCAGAACAGGCTGATCGGCTGGGAGGCTCCACGGGCCCTCGAAGGTCAGGTTAGGCGAGGC<br>AAGCAGTCATATAGACTGGTGCCCCTTGGCCGGCAGGCACTCAATCTTAGAAAACCCGAAGAAAGGCAGGCG<br>CTCGAGAATTTGTATAGGATCCGACTGGAAAACATCTTGAAAGCCCTCGCCAAACGACATAGGGCTAGAGTC<br>GAACGCAGGGGCAACGGCCTTTTTCTGTGGAGGCCAGAGAATCCCCGAGAGGAGAAGGAGGGGTGGCACCTT<br>TACCGGGGAAGCCTGTACCGCATACATCTCTATCCTGACGGCGAAGTGATACTTGAAGTCGACGTGCAGCAT<br>CGATTTCAACCCACTCTCCATCTCGAGGAGTGGCTGCAACGAGGCTATCCACTCCCTAGGCGCGTGACTAAC<br>GCCTACGAGGACGAGAAAGAATGGGCACTCCTGGGCATCGAAGAGGGGAAGGATCCCCGCTCTTTTCTCTTG<br>GATGGGGGCGAGTCATTGCTTGACTACCATCGCAAGAAGGGACGATTGGCAGAGGGGCAGGACCCCGGTCGA<br>GTGGTCTGGGTTGCTAGAGGTAAAGAACGCGAGCGGATCCCACATCTGAGCGTCTTGTTGAAGCCAGTCATC<br>ACCATGGAGCTGCTGGCGAAGTCGCTGAGGTCACGCAGGAGGCCTTGCCTGCGCTTCAGCTCGAACCCGAG<br>GAACGGCTGAAGGACATTAGGCGCTTCGCTGAACCTGTACTGCAAGCGTTCGGCAAACGCGAAACTGCAAAA<br>CCCCTTGAAGGCAGAGCCCAGCGATTGCCGCAGCCCAGTTTGTTGGCACGGGGAAAAAAGCGAGTGGGCAAA<br>GTAGCGGACGTACTCGAAAAGGGAGCATTGTCACCGGGCGAGACACGGTTGGCCCTGCTCGCATGGGAGGGA<br>GACGGGAAGGCCAAAGGCGGTCTCGCGTACTTGGAGGAGAGGCTTCAGGGCGTCGGGTCTGCATCCGGCATC<br>AAACTTGAACTTAAACGGCGATTTCTGCCCCGAGGCGATAACCTCGAAATGGCACAGGTGTTTGAGGAGCTC<br>TCCCAGGAAGGAGTAGGTGCCGGTCTGCTTCTGACTCCCGCGCCTCACAGAGGGGAAGCGCGAACTGAAA<br>AATACTGCGGCGAGCCATGGGCTCGCTCTCCAACTCCTTAACCCGTTTGACCCTGGCGACATCTACAGGGTG<br>AATAACGCTCTGCTTGGATTTCTCGCAAGGCCGGGTGGCTGTTCCTGAGACTGGAGGGAACTTATCCGGCC<br>GACCTGGTGGTGGCCTATGACGCAGGCGGGGAGAGTCTCCGATTCGGCGGAGCCTGCTTCGCCCACCTGACT<br>GATGGCACGCATCTGGGGTTCAGTCGCCAGCCGCTCAGGGTGGTGAACGGATGGCCGAGGAGGTCGCGTGG<br>GAGTTGCTGCGACCCCTGCTGTTGAGATACCGGAAAGCGAAGGGCCAGACACCAGGGAGGATCTTTCTGCTC<br>CGCGACGGTAAGATTCAAAAGGAAGAGTTCCGAAAAGTGGAAGAGGAACTGAGAAAGCGCAATATTCCCTAC<br>GCGCTGTTTAGCGTCCGGAAGACGGGGGCTCCCCGACTGTTCAGCAAAAATGGGCCGCTCGGTGACGGTCTT<br>TTTTTGCGACTGCCAGAGGAGGAGGGCGGGTTTCTGTTGCTTAGCGCCGAGGGTGGGAAGGGCACCCCACGG<br>CCGGTTAAGTATGTGTTGGAGGCGGGAGAAGTGGACCTCAACCTGGAGGAAGCTGCCAGGCAATTGTATCAC<br>CTGAGTCGCATCTACCCGGGCTCCGGTTACCGATTCCCCAGGCTGCCCGCACCGTTGCATATGGTTGATAGG<br>ATGGTGAGGGAGGTTGCACGGCTCGGCGGCAGCCATAACTTGAGACTCAAAGAAGAACAACTGTTTTTCCTG |
| 190 | 41 | ATGAATAACCTGACACTGGAGGCCTTTCGGGGCATTGGCACCATCAAGCCACTGTTGTTCTATCGGTACAAG<br>CTGATCGGCAAAGGGAAAATAGAGAATACCTATAAGACGATACGCAACGCACAGAATCGGATGCTTTCAAC<br>AATAAGTTTAAGGCCACCTTCAGTAAGGATGAAATCATATACACCCTGGAGAAGTTCGAGATTATCCCGACG<br>CTGGATGATGTGACGATCATCTTCGACGGGAAGAAGTGCTTCCTATAAAGGACAACAACAAGATTTACAGC<br>GAGGTAATAGAATTTTACATTAACAACAATCTCCGGAACGTTAAGTTCAACTATAAGTACCCGAAGTACAGG<br>GCTGCCAATACAAGGGAGATCACGGGCAACGTGATCCTCGACAAAGATATGAACGAAAAGTACAAGAAGAGC<br>AACAAAGGCTTCGAACTCAAACGGAAGTTCATAATCAGCCCAAGGTCGACGATGAGGGTAAGGTCACATTG<br>TTCCTGGACCTGAACGCGTCATTTGACTACGACAAGAACATCTACCAGATGATAAAGGCCGGAATAGATGTG<br>GTAGGAGAGGAGGTCATCAACATCTGGAGCAATAAGAAGCAGCGCGGTAAGATCAAGGAAATCAGCACATT<br>AAGATAAACGAACCCTGCAACTTCGGCCAGAGCCTGATAGATTACTATATAAGCAGCAATCAGGCGTCACGG<br>GTGAATGGATTTACGGAGGAAGAGAAGAACACAAACGTCATCATCGTGGAAAGCGGCAAAAGCCGCCTGTCA<br>TACATACCGCACGCGCTCAAGCCTATCATAACGCGAGAGTACATCGCCAAGAACGACGAAGTCTTTAGCAAG<br>GAGATAGAAGGGCTCATCAAAATCAATATGAATTACAGGTACGAGATTCTCAAGAGGTTCGTCTCCGACATC<br>GGCACTATTAAAGAACTGAACAACCTGCGCTTCGAGAAAATCTATATGGACAATATAGAAGCTGGGTTAC<br>GAGCAGGGTCAACTCAAGGACCCCGTGCTCATCGGCGGCAAGGGTATACTTAAAGACAAATACATGTCTTC<br>AAGAGCGGCTTCTACAAATCCCCCAATGACGAAATTAAGTTTGGCGTGATATACCCGAGAGGCTACATAAAA<br>GATACCCAGAGCGTTATCCGAGCCATCTACGACTTTTGCACCGAGGGCAAGTACCAGGGAAAGGATAACATA<br>TTCATCAATAACAAGCTCATGAACATCAAGTTCTCCAATAAGGAGTGCGTCTTTGAAGAGTACGAGCTCAAT |

TABLE 18-continued

Argonaute and helicase DNA sequences

| SEQ ID NO | Argonaute # | Sequence |
|---|---|---|
| | | GACATAACCGAGTATAAGCGGGCTGCAAATAAGCTCAAAAAGAATGAGAACATAAAGTTCGTGATCGCAATC<br>ATCCCCACTATCAATGAAAGTGACATTGAGAACCCCTACAACCCCTTCAAAAGGGTCTGTGCCGAGATCAAC<br>CTCCCCAGCCCAAATGATCAGTCTCAAAACTGCAAAGCGGTTCAGCACCAGCAGGGGCCAATCTGAGTTGTAT<br>TTCCTGCATAACATCAGCCTCGGCATTTTGGGCAAAATAGGCGGCGTACCCTGGGTAATTAAGGACATGCCA<br>GGCGAGGTCGATTGTTTTGTGGGCCTGGACGTGGGCACAAAAGAGAAAGGAATCCACTACCCCGCATGCAGC<br>GTGCTGTTCGACAAGTATGGCAAACTCATTAACTACTACAAGCCGACGATCCCGCAGAGTGGAGAGATCATT<br>AAAACAGACGTGCTGCAGGAGATCTTTGACAAGGTTCTGCTGAGCTACGAGGAGGAGAACGGCCAGTATCCC<br>CGCAACATCGTGATACACAGGGACGGCTTCAGCCGGGAGGACCTGGAGTGGTATAAGAACTACTTCCTGAAA<br>AAAAACATCGAATTCAGCATAGTAGAGGTCCGCAAGAACTTTGCCACGCGACTTGTAAACAACTTCAACGAT<br>GAAGTGTCCAACCCAAGCAAAGGTTCATTCATTTTGAGGGACAACGAAGCGATTGTCGTCACGACGGATATT<br>AACGACAACATGGGAGCGCCCAAACCGATCAAAGTTGAGAAAACGTATGGCGATATTGACATGCTCACAATT<br>ATCAACCAAATTTACGCACTGACACAGATTCACGTGGGGTCCGCGAAATCCCTTAGACTGCCTATAACCACG<br>GGCTACGCCGATAAGATCTGCAAGGCTATCGATTACATCCCGAGCGGCCAAGTCGATAACAGGCTGTTCTTT<br>CTG |
| 191 | 1 | ATGAACTATACCGCTGCTAACACAGCGAACTTCCCGATATTTCTGAGCGAAATAAGCTTTCTCACAACCAAT<br>AACATTTGCTTGAACTGTTTCAAGCTTAACTACCAGGTAACGAGGAAGATCGGTAACCGATTTTCATGGCAG<br>TTCAGCAGGAAATTCCCCGACGTTGTAGTGATATTCGAAGACAACTGCTTCTGGGTCCTGGCAAAGGACGAG<br>AAGTTCTTCCCCTCACCAACAGTGGAAGGAAGCACTTAGCGATATCCAGGAGGTTCTTAGAGAGGACATC<br>GGGGACCACTACTACAGCATCTATTGGCTTAAAGACTTTCAAATAAAGGCCCTTGGTGACCGCCCAACTGGCG<br>GTGAGGATACTCAAGATTTTCGGCAAATTTAGCTACCCAATCGTCTTTCCCAAGGATAGCCAGATATCAGAA<br>AATCAAGTGCAGGTCAGGCGCGAAGTTGACTTTTGGGCCGAGATCATCAATGACACCAACCCCGCAATCTGT<br>CTGACCGTGGATAGTAGCATTGTGTACAGTGGCGACCTTGAACAGTTTTACGAAAACCACCCCTACAGGCAA<br>GACGCCGCTAAGCTGCTGGTGGGACTGAAGGTGAAGACCATCGAAACCAATGGCACCGCGAAGATCATACGG<br>ATCGCCGGTACCATAGGCGAGCGCAGAGAAGACTTGCTGAAGAAGGCCACAGGCTCAATGTCACGACGGAAA<br>CTGGAGGAAGCCCATCTCGAACAACCCGTCGTCGCAGTCCAGTTCGGAAAGAACCCCCAGGAGTACATATAC<br>CCGCTTGCGGCCCTTAAACCTAGCGTGACCGACGAAGATGAGAGCCTCTTCCAGGTCAACCACGGAGACTTG<br>TTGAAGGAGACCAAGATCCTGTATGCGGAGAGGCAGGAGCTTCTGAAGCTGTACAAGCAGGAGGCCCAGAAA<br>ACCCTGAACAACTTTGGGTTCCAGTTGAGGGAGAGGTCCATCAATTCTCAGGAATATCCTGAGGTGTTTTGG<br>ACTCCCAGCATCAGCCTGGAGCAAACCCCAATCTTGTTTGGCAAGGGGGAGCGAGGTGAAAAAAGAGAGATT<br>TTGAAGGGCCTGAGCAAAGCCGGAGTGTACAAAAGGCACAGGGAATACGTGGACACAGCTCGCAAAATTCGC<br>CTGGCCATACTTAAGCCCGCTAACCTCCGCGTGGGCGACTTTCGGGAGCAACTTGAGAAGCGATTGAAGCTT<br>TATAAGTTTGAGACAATTCTGCCACCGGAGAACCAAATTAACTTCAGTGTCGAAGGCGAAGGTTCCGAAAAG<br>AGGGCCCCGATTGGAAGAAGCGGTCGACAGACTCATAAGGGGGGAGATCCCCGTAGACATTGCACTGGTGTTC<br>CTCCCGCAGAGCGATAGGAATGCAGACAACACCGAGGAGGGAAGCCTTTACAGTTGGATCAAGAGAAAATTC<br>CTCGATAGGGGCGTGATTACAGATGATTTATGAGAAAACGCTTAACAATAAGTCACAGTACAACAACATC<br>CTGAACCAGGTGGTGCCGGGGATTCTTGCGAAGCTGGGAAACCTGCCATACGTTCTTGCAGAGCCGCTTGAG<br>ATAGCCGACTACTTCATAGGCCTGGATGTGGGGCGGATGCCAAAGAAGAATCTTCCGGGGAGCCTCAACGTG<br>TGCGCGTCTGTCAGGCTCTATGGCAAGCAAGGCGAGTTCGTGCGCTGCCGCGTCGAGGACAGCTTGACCGAG<br>GGCGAAGAGATTCCCCAGCGGATCCTGGAAAATTGCCTGCCCCAAGCAGAACTTAAAAACCCAAACTGTCCTT<br>ATCTCACAGAGATGGTAAATTCAGGGAAAGGAGGTGGATAACCTTTTGGCTAGGGCTCGCGCAATCAATGCC<br>AAGTTCATACTGGTTGAGTGCTACAAGACCGGTATCCCCCGACTGTATAACTTCGAGCAAAAACAGATCAAC<br>GCACCCTCCAAGGGGCTGGCACTCGCGTTGAGCAACCGAGAGGTGATCTTGATTACGAGCCAAGTGAGCGAG<br>AAGATAGGCGTTCCTCGGCCACTTAGACTCAAAGTGAATGAGCTGGGTGAACAGGTGAACCTGAAGCAGCTG<br>GTCGATACCACTCTTAAACTCACGCTGCTCCACTATGGGTCTCTGAAAGACCCACGGCTGCCTATTCCCCTG<br>TACGGTGCCGACATCATAGCCTATCGGCGGCTGCAAGGAATCTACCCATCCCTTCTCGAGGATGATTGTCAG<br>TTCTGGCTG |
| 192 | 65<br>(Helicase) | ATCACCAGCTACCCTTACGCTAGGAACAAGGCCGACATGATTCGCAAGGTTAATTGGAATCTGATCGTGTTC<br>GACGAAGCCCACAGGATGAGGAATGTCTATAAGAAGTCCAATAAGATCGCCCGAACCCTGCGCGAGGCCACT<br>GCCGGCTATCCCAAGATCCTGCTCACTGCAACCCCCCTCCAAAACTCCCTCATGGAGCTCTACGGATTGATA<br>TCTTTTATTGACCCCCACATCTTCGGGGATGAGACAACTTTCCGCAGACAGTTTAGTCGCGGCACCAAGGAA<br>ATGAGCGAGATGGACTTTATCGACCTGAAACAACGAATTAAACCCGTGTGTCACCGCACCCTGAGGCGCCAA<br>GTCACAGAGTACGTTAACTACACTCAGCGCATTCCGATCACCCAGGAGTTCATGCCCACCAACGAAGAATGG<br>GAGCTGTACGAGAAGGTCAGCGCCTATTTGCAACGAGAACATCTCTTCGCGCTCCCCGCGTCACAACGAGCA<br>CTTATGACCTTGGTAGTGCGCAAACTGCTCGCCAGCTCTTCATTTGCTATTAGCGATACCCTGCTGAGCCTC<br>ATCAAGAGGTTGGAACAACTGCTGGAACAGCTGGACTCCGGCAAGACGGAGATTACCGTAGAACACAGCGAT<br>GTCTACGCGGACGTGGACGAGTTTGATGATACAGTGGAGGAGTGGGAGGAGGACGACCAGCCTTCTTACATA<br>GATAAACTGAGCCCAGACGAGATGAAACGGTTGATTCAGGAGGAAAAGGAAGAACTGGAGCAGTACTACAGC<br>CTTGCAAAAAGCATTAAAGAGAACTCAAAGGCTGAGGCCCTCCTCATAGCCTTGAAAAAGGGTTTGAAAAG<br>CTCAGGATGCTGGGGGCTAATGAGAAGGCCGTGATCTTCACAGAATCCCGACGCACACAGATGTATCTGAGA<br>GAATTCCTGGAGAGAAACGGCTACGCCGGGAAGATAGTGCTGTTCAACGGTGAAAACCAAGACGAACAAGCG<br>AAGCAGATCTATGAGCAGTGGTTGGAGAAGCACCGACACGACGACAAGATTACGGGCTCTAAGACGGCGGAC<br>ATGCGAGCCGCGCTCGTGGAGTACTTTAAGGAGCAGGCTAGTATAATGATAGCGACCGAGAGCGCCAGCGAA<br>GGCATCAATCTGCAATTTTGCAGCTTGGTTGTGAACTATGACTTGCCATGGAATCCGCAAAGGATAGAGCAA<br>CGGATCGGGAGGTGTCATCGCTATGGTCAAAAGCACGACGTGGTGGTAATAAACTTTCTCAATTGTAAAAAC<br>GAAGCGACCAAGAAAGTAGATGAGATATTGTCCGAGAAGTTTCGGCTGTTTGAGGGCGTATTTGGCAGCAGT<br>GATGAAGTCCTGGGGTCCCTCGAAAGCGGCGTGGATTTCGAGAAGAGAATCCAACAAATCTACCAGACCTGC<br>CGAACCGCGGAAGAAATTGAGCAAGCGTTCAAGAACCTGCAAGCTGAGCTCGACGAGCAAATTCAACTGAAG<br>ATGAAGGAGACCGAATGCATCTTTTGGAAAACTTCGATGACGAGGTGAGGGAAAAGTTGCGAGACCATTAT<br>CACCCAAACCTCCCTGCATCTGAATAGGATGAAAGGTATTTGTGGAACCTCAGCAAGTACGAGGGGGCACGC<br>GAAGCCATCTTTGACGACGAGACGCTGTCCTTCGTGAAGGACTACGAGACCTATCAGATGATCAGCCAGGCG<br>AAGAAACAAAACAGTCCAAACGTGCATCACTTTCGATTCTCCCACCCGCTTGCGCAGAAGTGGATCGAACAG<br>GCCAAGAGCAGGGAATTGTTGCCAAAGGAGATAACGTTCAGGTACAGCGACTACAAGGGCAAAGTCTCCATC<br>TTGGAAAGACTCATCGGCAAGGAGGGTTGGTTGAGTCTGGACCTGCTTCACGTTCCAGAGCCTTGAGAGCGAA |

TABLE 18-continued

Argonaute and helicase DNA sequences

| SEQ ID NO | Argonaute # | Sequence |
|---|---|---|
| | | CAACACCTCATCTTTAGCGCCATCGACACCGAGGGCGGTCAACTGGACCAGGAGATGTGCGAGAAAATGTTC<br>GAGCTGCCCGCTGTGGAGGGCGAGGAAGTAGAGATATCCGACTCCATCCGAAACACATTGAGACGAATCTCA<br>GAGGGCCAGCAAGAGGCAATACTGAATGAGATTATGGAACGGGCGTCCGCCTACCTCGACTCAGAACTCGAG<br>AAACTGGAAAATGGTCACAGGACCTCAAGAATAAGCTGGAGAAAGACATTGATGAAATGACGGTGGAGATC<br>GAGCATCTTAAACGGGAAGCTAAATTGACACGCAACCTGGCAGAAAAACTCGAAAAAAACAAACAGATCAAG<br>GAGCTTGAGAAGAAGCGCAACGAAATGCGCCGGAATCTCTATGACCAACAGGACGAAATCGATGAACAAAAG<br>GACCGCCTCTTCGAGGAGGTAGAGAAAAAACTTGAACAACGGACTGCGACGGAGCACCTCTTCACTATCAAA<br>TGGCGGATCGTG |
| 193 | 44 | GTGAACCATTACTATTTTTCCGAATGCAAGGCGGACGAGAAAGCCAGCGACATAGCCATCCACCTTTACACC<br>GTGCCCCTGTCCAACCCCCATGAGAAATACAGCTATGCGCACAGCATCGCCTATGAATTGAGAAAACTCAAC<br>TCATACATAACCGTGGCCGCGCACGGTCAGTACATCGCGTCTTTCGAGGAGATATGCCACTGGGGCGACCAC<br>AGGTACATACAGCACGAACATAGACCAATCCAGTGCAGCCTCCCGATGGAGAGGACCATACTGGAAAGACTC<br>CTCAAGAAAGAGCTCGAGAATAGGTGCAAAAGCAGCTATAAGATGGACAACGACCTTTTCCGGTTGGCTAAC<br>GAGCAAAGCATGCACGTGGGCGAGATCAGCATACACCCAGCGATCTACATCTCATTCAGCGTGGAGGAAAAT<br>GGTGACATATTTGTTGGCTTCGACTACCAGCACCGGTTCGAGTACCGCAAAACACTCCAAGACGTCATCAAC<br>AACGATCCCTCCCTGCTTAAGGAAGGCATGGAAGTGGTGGACCCCCTTCAATAGAAGGGCCTACTATTACACT<br>TTTGTGGGCATGGCCGATTATACCGCCGGACAGAAAAGCCCCTTCCTGCAGCAGTCTGTGATCGACTATTAT<br>CTCGAAAAGAATGAGCTGTGGAAGCTCAAGGGTGTGCACGAAAAAACCCCGTGGTGCACGTCAAGAGCCGA<br>GACGGTCACTTGCTCCCGTATCTGCCGCACCTGCTCAAATTGACATGTTCATACGAACAGCTCTTGCCCAGC<br>ATGACCAAGGAAGTCAATCGCCTGATTAAGCTGAGCCCCAACGAGAAGATGAGTAAGTTGTATACGGAGATG<br>TTTCGATTGCTCCGGCAGCAACAGGTGCTGACCTTCAAGAAGGAAAACGTGCGAGCCGTCAACCTCGGCTAC<br>GATGTGAATGAACTTGACAGCCCGATCATGGAGTTCGGACAAGGCTACAAGACAAACGAGATCTATCGAGGC<br>CTGAAGCAGAGCGGAGTATACGAGCCCAGCTCAGTGGCCGTGAGCTTTTTTGTTGACCCCGAGCTTAACTAC<br>GACCCCCAGAAGCGGAAAGAAGTAGGTTGCTTCGTCAAAAAACTGGAGAGCATGAGCGAGGCCCTGGGAGTA<br>AAACTGAACATAAGCGACCAGCCCCGACAACTTTATGGCCAGCTCCCCAAGGACTTTTTCAAGCAGGACAAC<br>CTCTCATATCATTTGAAATCTATCACCGACCAGTTCAGGGGAACGGTGGTGGTTGTTATCGGCACTGAAGAG<br>AACATCGACCGGGCATACGTTACAATCAAAAAGGAATTCGGCGGCAAGGAGGATCTGATGACCCAGTTTGTC<br>GGCTTCACCTCCTCCCTCGTCACGGAGAACAACATTTTTCACTACTACAACATCCTGCTCGGCATCTATGCG<br>AAAGCTGGTGTTCAGCCCTGGATACTCGCCAGCCCAATGCACTCAGACTGTTTCATTGGACTCGACGTAAGC<br>CACGAGCACGGTAAGCACGCATCAGGGATAATACAAGTGATTGGACGGGACGGCAAGATTATCAAACAAAAG<br>AGCGGTTGCGACAGCAGAGGCCGGAGAGACTATTGCCAATAGCACGATGGAAGAAATCGTCAACGAAAGCATT<br>TATTCCTACGAGCAGATCTACGGGGCCAAACCGCCACATAACATTCCATAGAGACGGGATCTGTCGCGAG<br>GACCTCGATTTTCTGCAAGCGTATTTGCGGAGTTTCCAAATCCCATTCGACTTCGTAGAAATCATAAAGAAG<br>CCGCGACGCAGAATGGCGATATACTCTAATAAGAAGTGGGTCACGAAACAGGGAATATACTACAGTAAGGGC<br>AACACCGCTTATCTGTGTGCCACGGACCCCAGAGAATCCGTGGGTATGGCGCAACTTGTCAAGATCGTACAG<br>AAGACTAACGGATTGAGCGTTCACGAGATAGTGAGCGACGTGTATAAGCGTGTCCTTCATGCACATACAGT<br>ATGCTCAAGACCAGGTTGCCTATCACGATACACTATAGCGACCTCAGCTCAACGTTCCACAACCGGGGCTTG<br>ATCCATCCCCGGTCCCAACATGAGAGAGCACTCCCGTTCGTG |
| 194 | 67<br>(Helicase) | ATGAATTTCCAGCTGTGCGACCAACGCAAAGCCATTATCGCCGAACCAGGCCATCTGTTGGTCCTCGGTGGG<br>CCAGGAAGCGGGAAAACTACCGTCGCCCTCTTCAAGGCCAAGCAGAGATTTAGCACTCTGAAACCTAGCCAA<br>GAAATCCTGTTCCTGTCATTCAGTAGAGCTGCCATCAGGCAGGTCCTGCTGCGGTGCAAGGAGATTCTGAAG<br>CCCGCAGAGAGACGCGCTGTCGCCGTTCAAACCTATCATAGCTTCTGCATGGACATGCTGAGGGCGCACGGT<br>AGACTGCTCCTGGGCCACCCGTGCGATTCATGTATCCCGGCGACGAGAGGCTTCAAAAGGCCGCATTCGAG<br>GGGGACTGGGAGGCGGAAAGACAAAGGCAAGCCAAAGAGATGGCATCTTTTGCTTCGACCTTTTCGCGCAA<br>GGCGCAGCTGAGTTGCTCGAGAGGTGTGCCGCACTTAGGAAGCTTTATAGGGGACAGCTTCCCCATGATAATA<br>GTGGACGAGTTCCAAGACACCGACGACAACCAATGGCGGATCGTGGCGCAACTTGCCAAGGTAGCGGACATC<br>TTCTGCCTTGCCGACCCCGACCAGAGGATCTTTGACTACCGAGACGACATCGACCCCCTTCGGATCGAGGGT<br>TTGCGGACCACTCTTGCCCCCAGGGAGTTCGATCTTGGCGGTGAGAATCACCGCTCCCGAACGCAGGGATA<br>TTGAACTTCGCCAACGCTGTGCTGCATAACCAGAGCCCCCTGCCCGATACCAGCGACATCATGCAACTGCGG<br>TACTGGCCTAGAGCGTTCGCGAGCACCGTGCATGCCTGCGTAGTGTTTACCTTCAGCGAACTCAGGAAACTG<br>GGCGTGGAGAACCCCAGCGTGGCAGTGCTGAGCGATCCAACGGGCTTATCAGCGATGTGAGCGCCATACTG<br>GCTGAGAAGCACGCGTACAACGGGAGGGAACTGCCAATCGTGGAACACGACGTGGTTTGGGACGCGGAGCTG<br>TCTGCGGCAGCAGCCGTCGTCGTTGCGTCCACCCTGGAGTGGCCAACAGCCGCTGCAGAGGTTGCTGTTGCC<br>AGGACACTTGCGCTCATAGCAGCCTATTACAAGCTGAAGAACGCCGAGGAACCCACCAAGAGCGCGGCTGAG<br>GCTGCCCAAAAGTACGAGGCGGCTGCAAGCAAGGTGCCAGTGAGGAGACCCCAAGGATCAAAGCCGCGAAA<br>GAATTGCTGGCCGCTCACCAAAGTGGCATCCAGATGGTGGGCGACCCGGTGGCCGATTGGAAGTCTGCGAAG<br>AGGGTATTGCAAGAGATAAGCGCCCTGGGTGAGTTGTACAGGGAGGTCCGGCTCGTGAGGTTGTTCCGGGCA<br>ACCGACGCCTTGGCTTCCGGCCTGAGCAATAGGTGGTTGCTACTGGAAGCTACGAGGGCGTGTCCGACCTG<br>GTGAAGGGCATCCTTGAGCAGGAGAAACTGATTGCCGTGGAAAGGGACCCAAGAGGCTGTATACTGATGAAC<br>ATCCATAAAAGCAAAGGTAAGGAATTCGACGGCGTGGTACTCATTGAGGGGGCATTTAAGTCCCATTTCTTC<br>GATGAGCGGAAGGAAGTCAGCCCCTATGAGAGGTCCAGACGGCTCCTGAGAGTCGGTCTGACCCGCGCTAGG<br>CATAGGGTGACAATCCTTAGACCTCAGGGAGCGAGGCCCCTTGTGGATCCCATC |
| 195 | 34 | GTTCCAGGCGGTAGGGGACCGCTGCTCGTGCTTAACTTCCTTCCCGCTCGCTTCGACGGCCGAGTTGATGCG<br>GGCACCCTCCCCTTCGAGACCCCTGATAAATTGAGGGCCATTAGGGAGGAACTGAGAACTTCCCATGTAGTT<br>GTAACGCGAGGAAAGAGGTCGTATGCGTGCCCTTCGTTAGTGGCGCGAAATTGATCGGCAAACGAACCACT<br>ATCACCGCAGCGGGACCCGACCTCGTCGTACAAACGAGTCTTCTCGAATCCAGCCTGAGGCGGACCTTGACC<br>GAAAAATGGAAGTACGAATTGCGCAGGGAAAACCCGCTCACCTTTGTGTCAAGGACGCAGGAAGGGACCTG<br>CTGGAGAAGGCCCTTGGTCGGGAGTTGCCGGGACTCCATGTGTTCCCCGCTTACAGCCTGGACGTGCGCAGA<br>TACGGTCCTGGGGGTTCAGCGGGGTTGTTGTAGGATTGAAGACCCGCTATGAGATCGACCTGCCTGTCGGA<br>GTGCTGCTCAGGAGGGCGTTCAAGTAAACGGCCTTTATGTCCTGGCTGAAAGCCCCCTCGCGCCTACGTGG<br>CCCTTCCAAGATCCCCACACCAGAAGGCGGCTCGTGGGACAAGTTGTCGCGGTGGATGGCGACAAATTGCGA<br>GTGAGGTGTAGGGACGGGGAGCTGGAACTTGATGCCGCCGAAGCATGGATTGAGCCCAACACTGCCAACTTC |

TABLE 18-continued

Argonaute and helicase DNA sequences

| SEQ ID NO | Argonaute # | Sequence |
|---|---|---|
|  |  | TACGCCGTCCTGCGGAAGGCGTGCGGACGCTCTTACGAACGAGACTTTCACGCCCTGGAAGCCCAAGTCGTG<br>TCCCTGACTAACGCCCAGCAGCGAATCGCCGATACCAACAGGATCGCCGCCAACCTGATAGGCCTTGGTAAA<br>TTCGACATCAGTAACGGCTTGACTGCCGAGCTGGGGAAACCACTCAGACTGACTTCCACTCAACATCCACAC<br>GTTCGGACTCTGGCCGAGCCCACATTTGTGTTTGACCAGAGCGGAGACAAAACCGCGCCTTTTCCCGAGACC<br>GGGCTGACCAAGTGGGGCCCATTGGACGCTGAGAGCTTTACACCCAAGGCACCACACATCGCCGTGGTGGTT<br>CCGCGGCAGTTTCAGGGTCGCGTCGAAACGCTGGTTGAGCGGTTCAGGAACGGCGTGAGGGGCAGCAACGCC<br>TATGCCGAGGGCTTTGTCCGAAAGTTTAGGCTCACCGACTGTACCTTCAGCTTCACCGTTTTTGACGGTGAC<br>GCTACTGACGCAGCCGCATATAGGCAAGCGTGCCTTACCGCCCTGAGTAATGACGAGCAAATTAACCTCGCC<br>TTCGTCTTCACATCAGCCGTGCAGGAGCATCAAACGGGGGACGACAGTCCCTATCTTGTCAGCAAATCCACC<br>TTCATGAGCCAGGGTATCCCCGTGCAAGAGTATCAAGTGGAGAACATCATCGGGGATTCAAACTTGGCTTAT<br>CCCCTGTCCACGATGGCGCTGGCGTGCTACGCCAAACTGGGTGGCACCCCTTACGCCATAAGCGATCGAGGA<br>CGACCTATGGCACGAGAACTGATCTTCGGCATCGGGTCTGCCCAGGTAAGCGACGGAAGGATGGGCGAAACA<br>GAGCGATTTGTGGGCATTACCACCGTGTTCAATTACGACGGTAGGTACTTGGTTAGCAACGTTAGCCGCGAG<br>ACACCCTACGAAAGGTACCCGCAAGCCCTGCTTGACGCATTGCGGACTTGCATTGCCGACGTGAAGGTTAGG<br>CAGGGATGGAGGTCCGACGACTTTGTGCGGCTTGTCTTCCATATCTTCAAACCTCTGAAGGACAAGGAAGCA<br>CGCGCCGTAAAAGAGCTGGTGACGGAGCTGACGTCTGAAATATGCCAGCGTGGAGTTCGCTTTTGTGACAGTG<br>GTGGACGATCACCCGTGGCTGGTGCTCGATGAAAACAGCGATGGGGTTAAGGTTGGGCGAGGGACTAAGGGC<br>AAGCACGTAGCTCGGAGGGGTTTTGCCCTGCCGATTTCCAAAAGGGAGCTTCTTGTGACGGTTAAAGGTCCC<br>CGGGAAATGAAATCCGATAAGCAAGGGGCTCCCAAGCCCCTCTTGCTCAAGCTCCATCGCGAAAGCACCTTT<br>ACAGACATCGACTACCTGGCCTTCCCAGGTCTTTCAATTCACCGCCCATGAGCTGGCGCAGGCCATACCCTACC<br>AGCAAACCCGTGACTATAAGCTACAGTGACCTGATTGCGGGACTTCTCGGAAAGCTGCGACACGTGACGAAC<br>TGGAATAGCGACATGATCTACATGAAGTTGCGCTTCAGCAGATGGTTCCTG |
| 196 | 30 | ATGCAGCAGGAGATCCAGCTTAACATCATCCCCTTCACCGCCCCTGTGGAAGAGGCAGAGTTCGCTTTTTAC<br>ACCGCCAAGCAAGACGGCTACTGCCCCATCCATAAGGATGACCTGAACGGGGCCATCGAAGGCCTCGTGGAT<br>GAATCAGACCTGCACTACGGCAACTGGCTGTACACTGACTTCGCTCCCGCCAAAGAGAACGCCATCATAATT<br>AGCGTCAATCTCAATGACTGTAAGTACTTCGCCCAGCACTACTACAGGCACCTTATCAGGACCCACTTCAAG<br>GGAGTGCCGACATCATGAGGAAGAATTTCAACAACGAAATCGAGGTCTGGTTCCACAATACCAAAGCCAGC<br>TCTACCAAGTTTAAGGTCTATAACCAGTTTACCCTCAAGGTACAGCACAACAGGGTGACGGACGGACCGGAA<br>CTTGTCGTGTCCTTCGACGGGACGACGAAGGTGCTGAACAAGTCTATCGCCGAGATACACAACTTCAAAACG<br>GAGCTTTACAACTGGATAAACTGCAACGGCGAGCTTAATCGCTGGAAATACCTGACCGACGATCAGAAGCTG<br>AATCACGAAAAGAACTACCCGGTAGTGTCAAACACACTTAAACCGCATTTTGACATTGCCTTTGACGTTCCC<br>GATTTTAAGAACCGGTATCCCAAATACTTCACTCTTCTGAATGACTTCTACAACAACTATCTGAATACAGAC<br>GCCTTTACTGCGATCTTGCCGCTTTCCGCTGACGGATTCTTCAAGCCAAATGGCCTGTCAGTGCAGAGGATC<br>AACGGCACTAGCAATGAGCTGCAATTCGGCAATGGCGTCGGCGTGGAGCCCAAAAGGGATCTCAAGCGCCTG<br>AAGCCGTATAAACCCGTGCCCAAACCCAGCAACGTAAAGTTTTTCTTCATCTATCACAAGCCAGATAGGGAG<br>CATGCGTCAAAAACATCTGGCAGTATTTCAAAGACGGATACAACGGCCAATACCCCTTCCCCAAGATGGAG<br>GAATACATATCTCAGCCCTTCGAGCTTGAGGAGAATGGATCTATCTCATTCGACAATATCGACGACGCGGTA<br>AGCGTTGTCCAAAAAGCCATCAAGAACAAGGATCGGCTGCCCGACACTAAATACTTTGCGGTATACATCTCC<br>CCCGTACCAAAATGGGAGAAGGACCCTAAACGGAATAGTATCTACCATCGGATGAAAGAGATACTCCTGTAC<br>GAGGGGATCACCAGCCAGGTGATCTGGAAGGAGAACATTAGCAAACCGGCTTTCAACCTCTTCTTGCCTAAC<br>ATCGAAACCGCCATACTGGCCAAGCTGGGAGGCGTCCCCTGGAGGCTCAAGAGGGACACCACGAACGAGTTG<br>ATCGTTGGCGTGGGTGCTTTCTACTCAATCACGCGGAAGTCCAAGTACGTGGGCTCTGCATTTTGCTTCAAT<br>AACGAGGGCATCTTTAAGGGGTTCGACTGTTTCGGTGCCAATGACACCGACAGCATCGCGGGCTCTATCAGG<br>GAGGCCGTGGGAAAGTTCATCGCGTCTAATTACAAGGCCCACAAGGCTGATCATTCACTTCTATAAGGACTG<br>TCAAAGAAGGAGCTCAAACCAATCATCGATACACTTCACGCCCTGGGCTTGCCCATCCCAGTGATAGTCGTG<br>ACCATCAATAAAACCGAGAGCAAGGAACTCCTGGCATTTGATACCAGCTCACAAAAGCTCATGCCCTACTCT<br>GGCACCATCGTGAAGGTGGGAGCCAAGGAGTACCTGCTGTTCAACAACACGCGATACGAGGAAGCATCCGCC<br>CCAACGGATCGCGAGCACCACTTCCCGGTGAAAATCAGCTTTTTCTCAGACAAGGCGGAGCTGTTGGACGAT<br>CCCGCACTGATCAACCAACTGATCGACCAGGTGTACCAGTTCAGCCGCATGTATTGGAAAAGCGTGAGCCAA<br>CAGAACTTGCCCGTAACCATTAAGTATCCCGAGATGGTGGCGGAGATTTTCCCATACTTTACCCACGATAAA<br>TTGCCCGATCATGGAAAGGAGAGCCTGTGGTTCCTG |
| 197 | 47 | ATGTATCTTAACCTCTACGAAATCAAGATCCCCTACAGGGTTAAACGATTGTACTACTTCAATAAGGAGAAC<br>GACCCCAAAGAGTTCGCCCGGAATCTGAGCCGAGTGAACAACATACGGTTCAACGACAGTAAGGACTTGGTG<br>TGGCTCGAAATCCCCGACATCGACTTCAAGATTACACCCCAGCAGGCGGAAAAGTACAAAATAGAAAAGAAT<br>GAGATAATTGGGGAGAAGGAAGACAGCGATCTGTTCGTCAAAACCATTTACAGGTACATCAAAAAAAAGTTC<br>ATCGACAATAACTTCTACTATAAACGGGAGAATAACTACATTTCAATCAATGATAAGTTCCCGCTCGATTCT<br>AATACAAACGTTAATGCGCACTTGACATATAAGATTAAACTGTACAAGATAAACGAACGGTATTACATTAGC<br>GTGCTTCCAAAATTCACCTTCCTCAGTGACAAGCCAGCCCTTGAGAGCCCCATCAAGAGCACCTACCTGTTC<br>AACATTAAAAGCGGCAAGACGTTTCCCTATATTAGCGGGCTCAACGGAGTCCTGAAAATTGACCTGGGCGAG<br>AACGGCATAAGGAGGTCCTTTTTCCGGAGAACTACTATTTCAACTTTACCTCCAAGGAGGCCGAGAAGTTT<br>GGGTTTTCTAAGGAAATCCATAACATCTACAAGGAAAAAATCTTCAGCGGCTACAAGAAAATCAAACAGAGC<br>TTGTATTTCCTCGAAGACATCATCAATATAAACAATTACAACCTTACCATGGACAAAAAGATCTATGTGAAC<br>ATAGAATACGAGTTCAAAAGGGCATCAGCAGAAACATAAAAGACGTGTTCAAATACAGCTTTTACAAAAAT<br>GACCAGAAGATCAAAATTGCGTTCTTTTTTAGCAGCAAGAAGCAAATCTATGAGATTCAACGCAGCTTGAAG<br>ATGCTGTTCCAGAACAAGAATAGCATATTCTACCAGACCATCTACGAGATGGGGTTCAGCAAGGTGATTTTT<br>CTCCGCGAGCCGAAGACTAACAGCAGCGCATTTATGTATAACCCCGAGACCTTCGAGATTAGCAACAAAGAT<br>TTCTTTGAAAACCTGGAGGGGAACATTATGGCAATCATTATACTCGACAAGTTTCTGGGCAATATCGACAGT<br>CTTATCCAAAAATTCCCTGAGAACCTCATCCTTCAACCCATACTCAAAGAGAACCTGGAAGAGCCGAGAAGTTT<br>TATATCATTAAGTCCTACGTCTATAAAATGGGAAACTTTATTCCAGAGTGCCAACCATACGTCATAAGGACC<br>CTGAAGGACAAGAACAAACCCTCTACATCGGCATCGACCTGTCCCACGACAACTATCTCAAGAAGTCTAAC<br>CTCGCCATCAGCGCCGTAAACAACTTCGGTGACATTATCTACCTGAACAAGTATAAGAACCTTGAGTTGAAC<br>GAGAAGATGAACCTCGATATAGTCGAGAAGAGTACATACAGATCCTCAACGAGTACTACGAGCGCAATAAG<br>AATTACCCCGAAAACATCATTGTTTTGCGAGACGGACGCGCTATCTCGAGGACATAGAGATCATAAAGAACATA |

TABLE 18-continued

Argonaute and helicase DNA sequences

| SEQ ID NO | Argonaute # | Sequence |
|---|---|---|
| | | CTGAACATTGAGAACATCAAGTACAGCCTCATCGAAGTTAACAAGTCCGTGAATATCAACTCCTGCGAAGAC<br>CTTAAAGAGTGGATTATCAAGCTTAGCGACAACAATTTCATATACTATCCCAAAACGTACTTTAACCAGAAA<br>GGTGTAGAGATAAAGATAATAGAGAACAATACCGACTACAATAATGAGAAAATACTGGAGCAGGTGTACTCA<br>CTGACGAGAGTGGTGCATCCCACCCCCTACGTAAACTACCGCTTGCCCTACCCCCTGCAAGTCGTCAACAAG<br>GTCGCCCTTACCGAGTTGGAATGGAAGCTTTATATCCCTTACATGAAA |
| 198 | 5 | ATGGAGGCGTACATAACGGAGATGGTGTCCAGGGAGAGGGCCAACGAGCTGGAGGTTTACGTGTACGTGTTT<br>CCACGGAAGCAATCCGACAACAACTACGAGGGTGTGTATCACATAATGAGGGCGTGGCAACGGGCTAATGAC<br>CTGCCTCTGGCGTATAATCAACATACGATCATGGCATTTTCCCCCGTGAGGCATATGTGTGGCTACACGCCG<br>ATGGAGACGCAGAACGCCATATTAACATTGACTCCCCATTCGAGAGAGCCCTGCTGGAGCGACTGATAAAG<br>AACAGCCTGATTTTTACAGCCGAGCGCCATTTGCATGCCAAGCGGGTAGGCCATGCGCTTCGGCTGAACCAG<br>GTGCAGCAAATCCGGCAGGTGATCATCTATGAGGCCATCGAGCTCTATGTAAATATCATTGAGAATAGAATA<br>AGCATCGGCTTTCACCTCACCCACCAGTTCGAGTACGTATACACTCTCCAGAGCATGATAGAACAGGGAAAA<br>ACAATCAGACCTGGAATGCGCGTCGTGCATTCTAACGGAAGGCAGCATTATACCTACACCGTGGAGAACGTA<br>GCAACATATGGGGTGACCGACAGATGCCCGCTGCTGCAGACCAGCATTTACCAATACTACGTCGAAAAAGGC<br>GCGCAGCACATTTTGCGCACCTTCACCCGATCGACCACCAGGGTGATCCACGTAAGAACGAAAGAGCAGAGGTTG<br>AGCTACGCGGCGACACTCCTGAAACCGCTGTGTACTTTTGAGACCATGCAACCCCAGGACGTGCTCAATGTC<br>AGCAAGTGCATCAAACTTAGCGCGAGCAAACGAATGAAATGTACTTACAGGTGGATTCAGCAACTCCGGGCA<br>CAGTACCGACACCTGACCTTTGCGCCGAACCCCTTCACGATCGCCCAGAATGGCTATAAACTTGATCAGCTC<br>AGCACCCCCAAGGTGCACTTCCACAGAGACTACGCCACCGTCGTGAGCGGAATGAAGACCGGCAAGCTTTAC<br>AAAGGCGGTAATATCAAGATCAGCGTGCTCTTCGACGAGGACTTTTACTTGAAACACCACATCACCAAGAAG<br>GACATATATCAATTCATTGCAGTCCTGCAGAAAATCGCCATCGCACAAGGCGTGAACATGACCATAAGCACG<br>AGCACCAAGTCCATTACGGGCAAGTTCACGGACGACTTTTTCCACCACTTCACCGAGGAGGTCGAAGCACTG<br>CAGCCCATCTTCGCGCAAACCACAGTTCTGGCATTCATTACCAGTACCCACCTGAGCAACAAGAAAACCAGG<br>AGTTACCAGCTGCTGAAACAGTACTTCGGCGGCAAGTGGGACATTGCCTCTCAAGTCATCACGGAGAAGACG<br>ATTGAGGCGTTCCAAAAAATCTTGCACAAGCACGGCCTGAAGAATTTCTACCCCAATGACGAACAGCACTGT<br>CTCCGCGTGATCGATGTCCTCAAGAATGAGAGCTTCTACTACACGGTCATGAACATCCTCTTGGGAGTATAT<br>GTGAAAAGCGGCATCCAGCCCTGGATCCTTGCTAATACAACCCACTCAGACTGCTTCATCGGCATCGACGTT<br>AGCCACGAGAACGGAAACTCTGCGGCTGGGATGATGAATGTTATCGGCAGCCAGGGCCACCTTATCCAACAG<br>GCGCCCCTGAACGGCATATTGCGGGAGAAAAGATTGACGACACCCTGCTCGCAAACTTGCTTAAACAAATG<br>ATTAAGGCATACCACACCCAGTTCCAGCGCTTTCCCAAGCATATAACAATCCACAGGGACGGCTTTTGGAGA<br>GAACACACTGCACTGGTCGAGAAGATCATGAGCCACTATGAGATTACCTACGACATCGTCGAGATCATCAAA<br>AAGCCTAATAGGAGGATGGCTTTCTTCAACAGCGTGGACAACACCTTTAGCACCAGGCAGGGGACAGTGTAC<br>CAACGGGGCAACGAAGCCTTTCTGTGCGCCACTAACCCTCAGCAGAAAGTGGGCATGGCACAACCAATCAAA<br>ATACATCAGGTGACCAAGACCCTGCCCTTCTCACACATCATAGAAGATGTCTACAACCTCAGCTTCCTTCAT<br>ATTCACGCTATGAATAAGATGCGACTGCCGGCCACCATACATTATGCCGACCTGTCTGCCACCGCTTACCAG<br>AGGGGCCAAGTGATGCCCAGGAGCGGTAACCAGACAAATCTGCCTTTCGTG |
| 199 | 45 | ATGACCGGCGAGACTAAAGTGTTGGTCGGGAGGCAACCCTTCGACGTGGATCGGCTGAATGAACTCAGAGAC<br>GAATTCCGGGAGACGCACGTGTTCAGAAGGGATGGCATCGACGATGTCATTGTTGATGTTCCGGTCGTGGCC<br>GGACAGAAGCGGCATCGGCAACGTCCAGGAGGAAATAGACCTGGCTAGGTACCAAAAGGTGTGGCCCTCCCTC<br>CTCAGTGCTGCTCTTGTCCGGGCGTTTAGCGGCGTAAGGGACATCCTGAGCGATAGGCCCGTGAGCGTGGTG<br>GGGAGCACACTGCGGGGTCTGGTTCAACATCCGGAACTCCCCGAATGGATGCAGAAACGCACACTCCTTAGG<br>TTCGACACCCGGACCATCTATGCTGGTGATAAAAGAACCTTTGGCTTGGTGTGCGAGGCCAGATTGAAAAAC<br>CTTATCCAAGGTAGTTGCGCGGAGCTGCTGGCAGTTGGAGTTTCCCCACTGGGTCGATATGTCCAAGTCGAG<br>GAGCCACATTACGATCCCAGGCTTATGAAAAAACGGCGCCTTGTGGGCAGGGTATCAGCGATCTCCGGCGAT<br>AATCTGGTGCTGGAGGACCATGCCGAGGGCTTTCCGACCGTGAGTGCAAAGCTGGCATTTCTGAGGCGCGA<br>AGGGAGATTTTTGACGACTGTGTGCGGAGGATTTTGAACTCTGATGCGGCCTCCGTGCTGAACAAGGCCGAA<br>GCTACTGCTGCCTCATTTTCACTCAGGGCCAGGTAGGAAAGAGCAAATAGAGGAGGCTCTCAAGTATCTCAGG<br>GAGAAGGTGAGCCTCGAAGCTGTACCCGGAGCGAAATTCGTGATCGGGCCGATGCTGAGTAGCGGCAACAAG<br>GGCTTCCCCATCACGGAGATGATCCCGAAACCCATTCTCGTGTTCGATCCGAGCGGTACACGGAAGGATGAG<br>TGGAACGAAAGGGGCATTAAGAAGAACGGGCCCTACGACCAGAGGACGTTTTCACCTAAGCAGTTGAAGGTG<br>GCGGTCATTTGCCAGGCGAAGCACGAGGGGCAGGTGGATGGATTCATCGCGAAGTTCTTGGAAGGTATGCCA<br>GACGTTATGACGGGCAAGAACCGAGTTGCTAGATATGGTGACGGTTTTCTGCGGCGATTCGCCCTTGAGAAA<br>CCTTCTGTGACCTTCTTCACAGCGCCCTCAGCCAAGGCGAGCGATTACCTGGTGGCCAGCCGGGCTGCGCTG<br>ACCAAGGCAACGGACGAGGGTTTCAAATGGGACCTCGCGCTTGTGCAAGTGGAGGAGGAGTTTAAGGGATTC<br>GACGACGAGAGCAACCCCTACTATGCCACTAAATCCGTCTTCCTGAAGCGAGACGTGCCGGTCCAAAGTGTA<br>CGACTCGAAACATGGCTCAGGCCGACAGCCAGCTGATTTTCTCTATGAACCACATGAGCCTGGCGACATAC<br>GCCAAGCTCGGTGGTACCCCTGGCTTTTGGCGTCACAGCAGACGGTAGCGCATGAACTGGTATCGGTCTT<br>GGCAGCCACAGCGTGGCCAACAGCAGGATCGGTAGCCAGCAACGATTCGTCGGGATTACGACGGTGTTCTCC<br>TCCGACGGGAGCTATCTGCTCTCAGACCGCACGGCGTTGTCCCCTATGAGGAGTATGCGACTGCGCTTTAC<br>GATACGCTCAAACGGAGCATCACTACGGTGAGGAAACAAGACAACTGGAGGTCTACGGATAAAGTCCGCCTG<br>GTGTTCCACATGTTCAAGCCCCCAAGGACACCGAGGCCGAGGCTATAAAACGGACAGTGGACGATCTGGAG<br>CTGGAGAACGTGACTTTGCCTTCGTGCACATCGCCCATCTCATCCCTACCTCATCTTCGACAATACACAA<br>AAGGGAATTGGTTTCCGAGACCCCAAGAAGGGGATACTCGGACCCGAGAGAGGTCTGCACTTGAAGCTGGGG<br>GACTACGAGTCCTTGATCGTATTCAGCGGCGAAGGAGCTGAAACAGGCAAGTGACGGGATGCCCAGGCCA<br>TGCCTGCTCAAGTTGCACCGGCTTAGCACGTTCACTGACATGACGTATCTGGCGCGACAGGCATTCGAGTTT<br>TCAGGTCATTCATGGCGAATGCTCTCCCAGAACCGTTCCCTATAACTATTAGGTACTCCGACCTGATCGCC<br>GAAAGGCTCGCAGGTCTCAACGCCGTCCCGGGTTGGGACGCGGAGGCTGTCAGATTCGGCCAAATCGGCCGC<br>ACGCTCTGGTTTCTG |
| 200 | 42 | CTGAAAATCAAAATTCTCAAGGAGCCGATGCTGGAGTTTGGCAACGGCGCTCACATATGCCCCAGGACCGGT<br>ATCGAAACCCTGGGAGTGTACGATAAGAGAGATGAACTGAGGAGGAGCGAGCTGCGAATAGGCATTGTGGGT<br>CGGGGCGAGGGCGTGGACCTTCTGGATGAGTGGCTCGACAAGTGCAAGCGCGGCATCGTGGGTAAAGAGGAG<br>ACCAAGTTCCCCAACTTGTTCAGGGGCTTTGGGGGCGTCGATGAGTACCACGGTTTCTACACCAAGATTCTG |

TABLE 18-continued

Argonaute and helicase DNA sequences

| SEQ ID NO | Argonaute # | Sequence |
|---|---|---|
| | | AGCAGCCCCCAGTATACCCGGACTTTGCAGAAAAGCGAGATTAACAACATCAGCAAGATCACCGCCCGAGAG<br>GACAGGGTAGTGAAGTGCGTGGAGCTGTACTACGAGCAGATCCGATTCCTGTCAGAGAACAGGAGCATTGAC<br>GTGATCGTGTGCGTCGTTCCCAATGATATTTTCGACAGCCTTACTAAGGCCACCGGAGACAAAGACACCGAG<br>TCCCTGGAGGCCTACCTCGAGCACAACTTTAGACGGTTGCTCAAGGCCCGCTGTATGCACCTTGGGATACCC<br>TTGCAGCTTGTGAGGGAGAAGACCATCCTGAGCGTGAAGCCTAGCATAGACCAGCAGGACCTTGCCACAAAG<br>GCTTGGAACTTCTGTACGGCCCTCTATTACAAGGGGAATAGGACTGTACCATGGCGCCTGGTGGAGGATAAA<br>TTCAAGCCTAAGACCTGCTACATCGGCATTGGGTTCTATAAGAGTAGAGACGGCGAAACGGTGAGCACATCA<br>CTTGCACAGGTATTCGACGAGTTCGGCCACGGGGTCATCCTTCGGGGAGCACCAGTTAGCCTGGACAAACGA<br>GACAAGAGGCCCTACATGGACGAGTCTCAGGCTTACGAACTGCTGGACAGTGCCCTGGCGGAGTACGAGAAG<br>GCCCTGATGCAAAAGCCCGCTCGAGTGGTGATCCACAAGAGCAGCAGGTTCCGGCCCACCGAGGTGAGCGGC<br>TTCAGCAGAGTGCTGAACGCGAAAGGAATCAGAACGAAGGACCTCGTGAGCATCACATCAACCGACATCCGC<br>CTGTTCAGCGACAAAAACTATCCCCCCACCCGCGGTACCTTGTTGTCCCTGTCTGAAACACAAGGAGTACTG<br>TATACCAAGGGAATCGTAGATTTTTACAAGACCTATCCGGGCATGTATATCCCTTCACCCCTGAGGGTTGAG<br>GCGTTCGAGTCCGACAGCTCTCTTGAAGACTTGTGTAAGGAAATCCTGGGCCTGACCAAAATGAATTGGAAC<br>AACACACAACTGGACGGCCGACTGCCCATTACCCTGGAATGCGCCAATAAGGTGGGCGATATCATGAAGTAT<br>GTGGACGCATCCGAAAAGCCACAGGTTGGTGTGGCCGTTGTTTATCTTCATGTTGGAGCAACTCGTACCCGGC<br>TGGAAGCTGCCTAAGGTGAGTACATGGGTAGCACGGGTAATTTTCCTGAATATTGTACAGGTGTCTATCGCT<br>CTGCTTGCCGGGATTACTTGGAATAAATGGATGATGGGCCACAGTTTGTTGCATACCAGCGATGCCCTGCCC<br>CCCTTGCTCGCAGGATTCGCCGCCTACTTCGTTAACACCTTCGTGACCTACTGGTGGCACAGGGCCAGGCAC<br>GCCAACGACACCCTTTGGCGACTTTTTCACCAACTGCACCATGCGCCCCAGAGGATCGAGGTGTTTACTAGC<br>TTCTACAAACACCCAACGGAAATGGTATTCAACTCTCTTCTTGGCAGTTTCGTGGCCTACGTCGTTATGGGG<br>ATCTCCATCGAAGCTGGCGCGTATTACATCATGTTTGCGGCTCTTGGCGAGATGTTCTACCACAGCAACTTG<br>CGAACACCGCATGTTCTCGGTTATCTCTTTCAACGCCCTGAGATGCACCGGATCCACCACCAGAGGGACCGA<br>CACGAGTGCAACTACAGCGATTTCCCCATCTGGGACATGCTCTTCGGCACCTACGAAAATCCCAGGAGAATA<br>GACGAACCACAGGGGTTTGCCGGCGACAAGGAACAGCAATTCGTTGATATGCTTTTGTTTAGGGACGTGCAT<br>TCCCTCCCCGGGAAGACACAACCAGCTCCCGTACTCGTCAAACCCGACGTGAGG |
| 201 | 78 (Helicase) | AAAGGGCGGCACCAGGCGAAACACTACGCGGACGGCCTGGAAAAAATGCACGGGCAAAGGCCTGTGATTTTC<br>TACACCAACGGCCACGATATATGGATATGGGATGACCATCCGGCTCAGCACTACCCGCCCAGACGGTTGTAC<br>GGATTCTACGCGAAGTCCAGCCTGCAGTATTTGATAAGGCAGCGCAGTGAACGCAAGGCGCTGAATACGGTG<br>AGCTCTAAAACCGATATACTCGGAGAAAGACTCTACCAGCACGAGGCACTGAAGCGGATCTGCGAACGCTTC<br>GAGACCAAGCAGAGGAAGGCACTCGCAGTCCAAGCGACCGGCACGGGGAAAACCCGCTTGTCCATCGCACTT<br>ACTGACTCTTGCATGAAGGCCGGGTGGGTGAAAAGGGTGCTTTTCCTGTGCGACCGAAGGGAACTTAGAAAA<br>CAAGCTAAGAACGCCTTTAGCGAATTCCTCAGCGCGCCTATTAGCGTACTGACAACGAAAAGTGCGCAGGAT<br>ACCCACAATAGAATCTTCGTGGCAACCTACCCCGCGATGATGAAGGTGTACGAGCAACTGGATACGGGATTC<br>TTCGACCTGATCATAGCCGACGAGAGTCACCGAAGTATTTACAACATCTACGGCGACCTCTTTCGCTATTTT<br>GACGCCCTTCAAGTGGGCCTGACCGCAACCCCGTGGAGATGGTATCTCGGAGCACCTGCCAGCTCTTCGGG<br>TGTGACTTTAAGCAACCAACTTCTAATTACACACTCGAAACGGCTGTGGAGGAGGGTTATTGGTGCCCTAC<br>CAAGTCGTGAAACATACCACAAAGTTTCTGCGCGATGGGATCAAGGGCCACGCGCTTAGCGCGGAGGAACTG<br>GCGGAGCTGGAGGACAAGGGCATCGATCCTAACACTCTTGATTTCGACGCCGAGCAGATCGACCGAGCGATC<br>TACAATAAAGACACCAATCGGAAAATCCTGCAGAACCTCATGGAGAACGGTATCCGGCAGCCGATGGCCAG<br>ACCCTCGGTAAGACGCTGGTATTTGCTAGGAACCACAAGCACGCCAAACTCCTCGAACAGTTGTTCGACGAG<br>CTGTACCCCCAGTACGGCGGTAAGTTCTGTCAGGTTATAGACAACTACGACCCCAGGGCGGAAGAGTTGATA<br>GACGATTTTAAGGGCGAGGGCAGCAACGAACAGCTCACTATAGCAATCTCAGTCGACATGCTCGACACCGGG<br>ATTGACGTCCCGGAGATCGTAAACCTCGTATTCGCACGGCCGGTTAAAAGCCCCGTGAAATTTTGGCAAATG<br>GTTGGTCGGGGAACGCGACTCTGTAAGAATTTGTTTGGACCCGGCAAGCACAAGACGCACTTCCTTATTTTC<br>GACCACTGGGGAGTCGTGGAGTATCACGGCATGAAACAACGCGAGGTAACTGTGTCCCAGAGCAAGTCCCTG<br>ATGCAGCAATTGTTTGAAAATAGATTGGAGCTCGCCAAGACCGCGTTGCACCACGCCGAAGCCGACTTTTTT<br>GAGACGATGCGGGGTGGCTGCACAAAACGATAAATAGCCTGGACGATCGAACGATTGCCGTTTGTGATAAG<br>TGGAAAACTAAGCAGCAAATGTCCGACCTGGAGACGCTTAGACAGTTCGGTGCAAACACCGTCACGCTGCTT<br>GAGTCAGAAATCGCCCCGTTGATGCAATGGCTGGATGTCAGAGGGCATAGTGACGCATATCAGTGGGACCTC<br>CTGGTCTCACAGATCCAACAACAAAAATTGAAGCAGGCGGCAGCCTTCGATGATCTCGCTGGGAGGGCAATC<br>AATCAACTGTGGCAGTTGCAGATGAATTTGAATCAAGTTAAGGCAAAGTCCGAGTGGATTAAGCAGTGCCGA<br>GAGACGGAGTGGTGGCAGAAGGCGTCCCTGGATGAACTGGAACAAATGCGACAAGAACTGCGGGGCATTATG<br>CAGTACAGGAACAAGGGTGACATTCCGAAGACAGAGGCGCCCATCATAGACATAACGGACTCAGAGGAGGTG<br>CGCGAGAAACAATCCTCCTACCTGAACTCAGTTGACATGGTCGCGTATCGGGTCAAGGTTGAACAGGCGCTC<br>CAGGAGCTCTTTGAGAGAAACCCCATCCTTCAGAAGATCCGGAACGGGGAGGCCGTGTCTGAGCGCGAGCTT<br>GAGAACTTGAACGCTCTCGTGCATACACAACACCCGGATATCGATCTCAACACACTTAAAAAGTTCTATGGG<br>ACCGCGGCTCCGATGGATCAAATCCTTCGGACAATAGTAGGCATGGACGGGAACACGGTTAATCAGCGCTTT<br>GCGGCGTTCATACAACAGTACCCCTCACTGAGTGCGCGCCAAGTTCAATTCCTGTCCCTGCTGAAACGACAA<br>ATTGCTCAGAGTGGGGCCATAGAGATTGACAACTTGTACGAAATGCCATTCGCAGCTATCGGCGAACCCGAC<br>AGCGTATTTAGTAACGCGAACAGATTGATGACCTTCTGGCGATTGTGGAGAGCTTCGGGAAGCAGCCCCAG<br>CAGCAGTCTACGAGACAGGCCAATGAGACA |
| 202 | 64 | ATGGATTACATACTTGAATTCGACGAGTTTATTCGAAGCATCAAGCAGAATATTGATACAAAGTATTCATTC<br>CTGTTGGGGGCTGGCGCTTCAGTCGAATCAGGTATTCCGTGTGCCAGCGAATGCATCTGGGAGTGGAAGAGG<br>GATATCTTCATCAGCCAAAATCCGACCCTGGCTGAGATGCACAACAACATCAAGAGCCAGAACATTAAGCGC<br>AGCATCCAGAACTGGCTCGATAACCAGGGCACCTACCCAAAGGAGGGCGAGGACATCGAGTATTCCTACTAT<br>ATTGAGAAGGCTTTCCGGATTCCCGACGACCGGAGGAAGTATTTCGAACGAAACATCACCGGCAAGACTCCG<br>TCACTGGGCTACCATATCCTGTGTCTGCTGGCGGAACGCGAGATAATCAAGTCCGTTTGGACAACAAACTTC<br>GACGGCTTGATCATTAAAGCCGCCCATAAGTACCAGTTGGTGCCCATCGAGGTCACCCTCGAGAGCCAAGAT<br>AGAATCTATCGGACGGATGCCAACAAGGAGTTGCTTTGCATAGCCTTGCATGGGGACTACAAGTACGGTCCG<br>CTGAAGAATAGTAAAGAGGAGCTGGACAGCCAGTCTGACATCTTCGTGAATGCCCTTTCCTTCGAGGCGTCT<br>AAGCGCTATTTTGTGGTGATGGGATACAGTGGGCGCGACAAAAGCCTCATGCAGGCTATTGAGCGAAGCTTT<br>TGCAGAAGCGGCGCTGGCCGCCTTTACTGGTGTGGATACGGCCGGAACATCGCGCCTGAGGTACGCGTGCTG |

TABLE 18-continued

Argonaute and helicase DNA sequences

| SEQ ID NO | Argonaute # | Sequence |
|---|---|---|
| | | ATCGAGAAGTTGAACTTGTATGGACGCGAAGCGTTCTATATTCCCACGGACGGGTTTGACAAGACGATGTTG<br>AACATAGCCCATATGTGTTTCGAGGATAAGGAATTGCAGGAAGAAGTGGAGAAACTCAAAGCGGATCTCGGT<br>GCGGGGTATGAGTGTGCGCACCACCACGTTCAGCCCCTACAAGGAAGGGGTGAATAAGATCGTGGACACAAT<br>GTTTACCCGATCAAATTCCCCGACAAGTGCTATCAGTTCGAGGTGAAGAACAGCAGCGTAATGAACCTCTGG<br>GATTACTGCAAGCAGCTGATAGACTATAACATTGTGGCCGTCCCCTATAACGGAATGATCTACGCCTGGGGA<br>AACCGCAACAGCATCAGCAACATGTGCGGACCAAATGTGAACGGGACGATCGAACTCGTTCCTCTCACTAGG<br>AAAATCTTTTTCGACAACGGCACTCTCAAGTCAATGCTCCTTAAAACTTTTGCTCATCGTGATTGGAAAGCAC<br>TCCAATTGCAAGTATAACCGAAACAAAATCTGGCGAGAGTCCAAGAAAATCAACTACACTATTAACGGCAAA<br>AACATTGAAGCGTACCAAGGCATTAGGTTTAGCTTGTTCATGGACTGGAAATACAGCTACCTCACCCTGACC<br>CCCGCTTTCTACTACAAAGACAGGAACAACGTTAGCAAGGAGGAGAACAAAGAGTTCAGCGACCGGTTTATG<br>GAGCAAATATGTAAGATGCAAGCCAATAAGAATTACGCCGCGTACATAAAACACTGGATTAACATTATCTTT<br>CCTGATGGCAAGTCCATCATTTCCATGTACCCGTGTAACAGCGAGAGCGGATTCGAGTTCACCATTGTTAAT<br>AAGTCACTGCTGGTCGGACTGCGGAGTAGGCAAGCACTGCATAATCCTGACGATGACATGAAGAAACGGATT<br>TGCATCGGTGGAGCTGAGTTGGCGGACACCGAGCTCAAGTTCTACAATCCGGCTCAGAATGCAATGCACACC<br>GACTTCCACCCCATGAGGGGCCTTATCAACAATAAGCCCTACGACTTCTACATGAATAACAGGCTGTTTAAA<br>TCTAACATCTCCCTGGGCGTGATCTCTCCTGTGGGTTCAGAGAAAAAGCTGGAGGACTTCCTGGACCGACTC<br>AACAAAAAGCACAAAGTGAACTACAACGTCGACTATGTCATAGATTATCCTGGGTTTCAGTCCGTCTACGGG<br>GTTGGCCTTTCTGTCCCTCTGATCGCAGAATGGGCGTTGTTGGATGATAAAATGCTGAATAAAGCCAACCTG<br>TATCAGAGCTGCCTTAACTTCGGGGATCAGATCAAGAAGAAGATTGAGTACCTGAAGAGCCGCGACAGCGTG<br>GACGTGATCATCATATACATTCCGAAAGAGTACGAGCTGTTCACCTTCTTCAACGACGGAAATATCCATTAT<br>GACCTGCACGACTACGTGAAAGCATTCAGCGTGCAGAGGCACATTAGCACCCAGTTCATACGGGAGAAACA<br>ATTGACTCTGAGCTTGACTGCCAGATCGCGTGGGCCCTCAGCCTCGCTATCTACGTTAAAGCAGGCCGCACT<br>CCGTGGATTCTCAGTGGCTTGAGGACTGATACCGCCTTCGCCGGCATCGGCTATAGTGTGGACCATATAAAG<br>ACCGACAACCAGACCCTTATCGGCTGTAGCCATATTTACGGGGCAGATGGCCAAGGTCTCCGGTACAAGCTC<br>TCCAAGATTAAGGATGTGACCTTCGACAGCAAGAACAATCCCTACCTGTCCGAAAACGAGGCCTACCAACTC<br>GGCCTGAATATCAAGGAACTTTTCTTTGATAGCTTCAAGACGTTGCCCCAACGAGTGGTCATACACAAAAGG<br>TTTCCGTTCCAGAAGCAGGAGATCGATGGCCTGACTAAGTGTCTTGGGTCCGCGGGAGTGAAAGACATAGAC<br>CTCATCGAAATCACCTTGGAGGATCGATTTAGGTGCTTTGAATACGACAGGCGACTCAGATTGACGGCTAC<br>CCCGTGAGGAGGGGCGTGTGCTTCGCCATCAACGAGAACACCGCCTATCTGTACACCCACGGTATTGCACCA<br>AGCGTCAAGATGCCAATCTCCGCTACATACAGGGCGGTAAGAGCATCCCTGCCCCCCTGAAAATCGTTAAG<br>CACTACGGGAACGGCGACCTGGCCCAAATTGCGACAGAGATCTTGGGCCTGTCAAAGATGAATTGGAACAGT<br>TTTGGTCTGTATAGCAAGCTTCCGTGCACTATCCAATCTAGCAACGCTATCGCTCGCGTAGGGTGGCTGCTC<br>TCCCAGTATGAGGGCGTAGTTTACGACTATAGGAATTTCATG |
| 203 | 70 | ATGAACAATCTGATGCTGGAGGCGTTTAAGGGCATTGGCACCATCAAGCCCCTGGTGTTCTATAGGTACAAG<br>CTCATCGGCAAGGGGAAGATTGAGAATACCTACAAGACGATCAGCAACGCCAAGAATAAGATGAGTTTCAAT<br>AACAAGTTCAAAGCGACGTTCAGTAAGGGAGAGACCATCTACACCCTTGAGAAATTCGAGGTCATGCCCAAT<br>CTTAACGATGTGACCATTGAGTTCGACGGAGAAGAGGTTCTCCCGATAAAAGACAATAATGAAATTTACTCC<br>GAAGTCGTGCAATTTTACATCAACAATAACCTTCGAAAGATCAAACTGGATAACAAATATCAGAAGTATCGA<br>GCAACGAATACCAGAGAGATAACTGGCAACGTCATACTCGACAAAGACTTCAAGGAGAAGTACAAGAAGTCT<br>AAGTCAGGGTTCCAGCTCAAGCGCAAATTCATAATTTCCCCCAAGGTGAACGACGAGGGTAAGGTAACCCTG<br>TTCCTTGACCTGAACAGCAGCTTCGACTATGACAAAAACATTTACCAGATGATCAAGGCCGGGATGGACGTG<br>GTGGGGCAGGAAGTGATTAATACGTGGAATAATAAGAAGCAGAAGGGCAAGATTAAGAAGATTTCTGAGCTG<br>ACGATCTCAGAGCCTTGTAACTTCGGCCAGTCCCTTATCGATTACTACGTTTCCCTCAACCAAGCTGTGAGG<br>GTGAAGAACTTTACGGAAGAGGAAAAGAACACAAACGTTATCGTCGTCCAGGTGGGAAAGGGCGAGGTTGAG<br>TATATTCCGCACGCGCTCAAACCCATCATTACTAGGGAGTACATAAAGAAATACGATGAGGCCTTCAGCAAA<br>GAGGTAGAAAACCTGATCAAAATCAACATGTCATACAGGTACGAAATACTGAAAAGTTCATCGACGACATC<br>GGCTCTATAACCGAACTGAACAACCTTAAGTTTGAGAACACGTACATAGATAACATCGAGTCACTGGGCTAC<br>CAACAGGGAAAGCTGAACGATCCCGTGCTGATAGGCGGCAAAGGCATCCTGAAGGATAAGATACATGTGTTC<br>AAATCCGGCTTTTACAAAAGCCCCATTGACGAAGTCAAGTTCGGCGTGATTTACCCGAAAGGCCACACCAAT<br>GATAGCAAGTCCACCATCCGGGCGATTTATGATTTTTGTACCGACGGGAAATACCAAGGCAAGGACAACATC<br>TTCATTAACAACAAACTGATGAATATCAAATTTAGCAACCAGGACTGCGTGTTTGAGGAGTACGAGCTCAAT<br>GACATAACGGAGTATAAGCGAGCCGCGAATAAGTTGAAAAACAACGAGAACATCAAGTTTGTAATCGCCATC<br>ATCCCCGCGATTGATGAGAGTGATATAGAAAATCCCTACACCCTTTTAAGCGGGTCTGCGCCGAGTTGAAT<br>CTGCCCAGCCAGATGGTAAGCCTGAAGACCGCGAAAAGATTCGGCACCAGCAAGGGTAATAACGAGTTGTAT<br>TTTCTGCATAACATTAGCCTGGGTATCTTGGGTAAGATAGGGGGGGTCCCTTGGGTCATTAAGGACATGCCT<br>GGGGAAGTTGACTGCTTCGTGGGCCTGGATGTGGGCACCAAAGAGAAAGGGATCCACTACCCCGCATGCAGC<br>GTCCTTTTCGACAAGTACGGCAAGCTGATTAACTATTACAAGCCCACAATCCCGCAGACGGCGAGATCATC<br>AAGACAGACGTGCTGCAGGAGATCTTCGATAAAGTGCTGCTGAGCTACGAGGAGGAGAACGGGCAGTATCCT<br>CGAAACATCGTGATTCACAGGGACGGGTTCAGCAGGGAGGACCTGGAGTGGTATAAGAACTACTTCATCAAA<br>AAGAATATAAACTTCACGATTGTAGAAATCAAGAAAAACTTCGCACCCGCGTCGCGAACAACATAAACAAT<br>GAAGTGTCCAACCCATTTAAAGGGAGCTTCATACTGCGCGAGAACGAGGCCATCGTTGTAACCACCGACATC<br>AAAGATAATATCGGCGCTCCGAAACCAATCAAAGTCGAGAAGACATACGGCGATATTGACATGATGACCATA<br>ATCAACCAGATCTACGCCCTCACGCAAATCCACGTCGGAAGCGCGAAATCTATGAGGCTGCCGATCACGACC<br>GGCTATGCCGACAAAATATGTAAATCCATCGAATACATCCCGAGCGGTAGGGTGGACAACCGGCTCTTCTTC<br>CTG |
| 204 | 61 | ATGGGCAGGCAACTCCAACTGAACTTTACCCCGCTCAGGGTTAGGGGCGACGCCATCAGACTTCAGGCGCTG<br>CCTTTCGAGGACGCTCAACAATTTAGGAATTCTGCGCGATGAGCATCGAGCACATTACGCTGTGACGAGAAGG<br>AGCGACCACATCGTGGCCCTCCCACTTACACTGAATGCCTCCCCAATCGGCGAGGAGAAGATCGTGAGCGTT<br>GTGGAGCATGCGAGTTTGATTCGGCCCCTGCTTGAACAGAGGTTGGTGACCCTTCTGTCCAGTAACCGGAGG<br>CCGGTGGCCCGGTATAATCCGATCACCACCATTGGAAGAACCTTGCCAACGGGCTTCATAGAAGCCGACCGA<br>CACCTCCATTTGCAGTCCCGCGTGCTTATTGCTATCCGCTCCCTCAAGCTGCCGGACGCCGAGCCCTTGGGA<br>TTGCTCTGGGACATCGAAATCCAGAAAACATGCGCGACTAGCCTTGCCGTCCTGCACGCACAAGGGGTACGG |

TABLE 18-continued

Argonaute and helicase DNA sequences

| SEQ ID NO | Argonaute # | Sequence |
|---|---|---|
| | | CTGGACGGTCTCACAGTGGAACGGCTTGTCCCGGTGGAGGACGTGCGAATGTTGCCTTATAGGCGACTGGTG<br>GGCAGAGTAGGCGCGCTGACCGATGGCCACGCCCGATTGAGCGAGCGGTTCCAGAACGTCGAAGAATTGCTG<br>CCCCTGGACGAGCTTTACCTGGAGGCCAGTCCGGAGAACCTGAGGCACCTTCTGCAGCATTTCATGCGCAAC<br>ACAAGCGGGCGAGTGCAAGGGAAGATAGACGAGATCGTCTTCGAGAACTCACGGGGACGCGCTCGGATGGAG<br>CACATTGCCCGGATCTCCGACTGGCTTAGAGGCCTGGGCGAGATTGAACTGCAGGAGGGTTTGTCTGTAGGC<br>ATCGGAAACCTGCTCTCTGAAAAGGACGCCCAGAACTTTCCCAGGTTCACTGAGGGAACGACCCCAACCTAC<br>GTGTTTGACGCTGGGACGTTGAAGAGCGAGTCAAGGGCCGCAGTGGGCCTCAGTAAATTCGGGCCCTACAGC<br>CGGCATGTATTTACACCGACTCGACCCAACGTTTGCGTCATCTGCGACCGCGCAAGAAGAGGACAGTTTGAG<br>CTGTTCCTGCGGAAATTCCGGGATGGCCTGACTGTTGATGGGAAGTCCCTGCCGTTTGGTCGCGGGTTTCTG<br>GGAATATATGGCCTTCAGGATATCAACCTGACCTTCGTCGAGGCGGATGCATTCACCGCGGACGCGTACCAT<br>GCTGCCGCAAGCAAGGCAGTACGGATGGGAGCCGAGGGCGCACCGTGGCACCTGGCACTCGTGCAAACAGAA<br>CGCGACAGTCGGCAACTGGCTCCCCCCAAGAATCCGTATTTGGTAGCGAAGGCGGCGTTTCTGTCTAATCAA<br>ATTCCTACCCAGTTTGTGGCGTTCGAGACATTTTCTATGGCGCCTCTGAACCTCGCGTACACACTGAGCAAC<br>CTGGCGTTGGCGGTTTATGCCAAGTTGGGCGGCATCCCATGGCTGATCAAGAGTGATAAAGGTATAGCCCAC<br>GAGGTCGTCATCGGGTTGGGTAGTGCCGCGATCGGGGAGTCCCGATTCAGCCGGAAGGAGAGGATTGTCGGC<br>ATCACAAGTGTTTTTCGGGGTGACGGCGGGTACCTCTTGTCTAACCTGTCCAATGCCGTGCCCATGAGCAAG<br>TACGGCGAAGCATTGACCGAATCTCTCCAGGCGACCCTGCAGAGGGTTCGCAATGAGATGAACTGGATCAGG<br>GGGGACAGCGTTCGGGTCATAGTTCACGCTTTCAAGCCAATGAGGAACACGGAGGTGGAGAGCGTTAAGGCT<br>GCGCTGAAAGAATTCAGCGAGTTCGACCTGCAATTTGCTTTCCTTCACGTTAAGCAAGACCACCCGTACCTC<br>CTTTTTGACGACGACAGCATCGGTACAAAAGGGCGAGGCGAGAAAACCCCCGTGCGAGGCTTGTTCGCGGAG<br>GTCGGACACAACGAGACACTGCTGACCCTGACCGGACCACAGCAGCTGAAGAGACCCACCGACGGGCTGCCG<br>AAACCGCTTCTGCTCAGCCTCCATAGGGACTCTACTTTCACAGATATAATCTACCTCACGAAGCAGGTGTAC<br>TGGTTTAGCAATCACTCATGGCGGTCTTTCCTGCCAGCAGCGATGCCGGTGACGATATACTACAGCGACCTG<br>GTGGCTGGTTTGCTCGGAAGACTGGATAGGCTGGGGTCTCGCTGGTCACCGAGTGTAATGCTGGGCAAGATC<br>GGAACCACAAGATGGTTCCTG |
| 205 | 12 | ATGGCCTATCCAATCGCTGACGACCGGCGAAAGTACTTCCACAGTCTTTTCGAGAACAAGGAGCCGTACATC<br>GGATACAAGGCTCTGTGTCTGCTGGCCAAGAACGACATCATCAAGAGCGTGTGGACGACCAACTTTGACGAG<br>TTGACTGTGCGGACCGCATTCCAAAGTAACTTGACCCCCATAGAAATAACCCTCGACAACGCAGACAGACTG<br>TTTAGGAACCAAAGCAAGAGAGAGCTGCTGAGCATATCACTTCATGGCGACTATAAGTATAGCACGCTGAAA<br>AATACCGAGAAGGAGTTGGACTCACAGGACGGCACCTTCAGCGAGCATCTGGGTAACTATCACGTCGACAAG<br>AACCTGATTGTGATAGGTTATTCAGGGCGCGACAAAAGTCTGATGAAATCCCTGAACGATGCATTCACCAAG<br>AGGGGCACCGGCAGGCTGTATTGGTGCGCTACGGTGACAAGATCAACACTGAGGTGGAAGAACTTATACGC<br>AACGTACGAACCGCTGGAAGGGAAGCCTTCTACATATCCACCGATGGTTTTGATAAGACGCTGATCGACCTT<br>TCTAAAAGCGCTCTGGAGGACAACAGCATGAGCCTCGAAAGCCTTAATTCCATCCTGAAACTGGCAAACAAC<br>GAGGAGCTCTCAAAGATCGAATTTAGCCAGAGCATCACCAGGACCGACAAATACCTGAAGAGTAATCTGCAC<br>GCAATTGTGTTCCCCAAGGAGATATTCCAGTTTGAAGTCGAGTTTGGCGACAACAAGCCCTGGTCATTCTT<br>AAAGACAAAACTAACAACACCGACATATGCGCCATCCCCTTCAAGAGGAAGGTTTACGCCCTGGGCACGCTC<br>AGCGGTATATCTAGCGTGTTCAAAACGTGCTCAAAAGCGAGATTAGGAGGGTACCAATCCTCCAAGTTCGAC<br>ATCGACAATGTGAGCAGCTTTAGGTCTCTCATGATCCAAACGGTGATCAAGCACTTTCTGTCATACGGAATC<br>TTCGACAGCAACCCTCAAGGACAAACTGTGGCTTAGAAATTCCGACAATTCCTTCGGGGACAAGAAAATACAC<br>AAGGCGATTTACCTCAGCTTCTACTTCGATAAGAGCAGCAAATTCGGCTACATTAGCTTCAGCCCCAGCATA<br>CACATAACCTCCGATAACGAGATCAGCAAGGAGGTGAAACAAAGGATTAGCAAAGAGATCTTGGAAAAGCTC<br>CGAAACGATAAGTTTGACGAAATACTGGAGTACTGGAACACCATACTGTTCAATTACAAAAATCTTAAGTTC<br>GAGTACCCCCTTAACAGCGGGACCGGATTCGAGTTCCAAATAAGCCGAAACACTGCGTTTGCCGAAATCATG<br>GTGCTGGACCCGAACTATCGAGTCTATAAACCAAGCGATTACAACAACAAGCTGACCCAGTTCAGAGGTGTG<br>CAGTATCTGGAGCCGCAACTGATCTTTCAGAACTCACTGAGTAACTCCCACACCAAGGACTACCACCCCATG<br>AGGGCGTTGACCAATAACAGGCCATACGACAACAACTTGAATGGCATCATCTATTCAAACGAGGTCAATTTG<br>GCCGTGATTTGCGGGGAAAACTACTCCAAAAACCTCTACGACTTCCTGAACCAGCTTAACCTTAAACACCCC<br>ACAGACAACATCAACCCCGATTTCCTTATAGAATATCCTGGCTTCGCGAGCGCCTACAACCTCCCCATCAAC<br>ATCCCATACTATGAGGACGCGGACAAGTGGATTAACATAGATTTGGAGAAGAGCAACAAGTCCGACAGCGAG<br>AACGCCATCATCGTTGCACGCCTCATCACAAGCAAATCGAGCAGATCATAAACATACAGTCTCAGCACACC<br>ATCGTCATCTTCATCCCCAAAGAGTGGCAGGCCTTCGAGAGCTTCCAGGAAAATGGCGAGGACTTCGACCTC<br>CACGACTACATCAAGGCGTTTAGTGCATCCAAGGGCGTGAGCACCCAGCTCATCAGGGAGGAGACACTGTCA<br>GACAGGTTGAAATGCCAGGTCTACTGGTGGCTGTCTCTGAGTTTTATGTAAAGTCTCTGCGCACGCCATGG<br>GTCTTGAATAATCAGGAGAAAAACACCGCCTACGCCGGCATAGGCTACAGCATTAAGAAGAACAGCAATGAC<br>ACCGAGGTGGTGATCGGTTGCAGCCACATTTACGATTCTAATGGCCAGGGCCTGAAGTACAAGTTGAGTAAA<br>GTAGATAATCATCCTGGATAAGCAGAGCAATCCCTTCATGAGCTATAATGACGCGTTTCAGTTCGGCGTG<br>TCAATTAGGGAACTGTTCTACAATAGCCTGGACAGGCTCCCCGAGAGGGTGGTTATCCATAAGCGGACCAAG<br>TTTACGAACGACGAGATAAAAGGTATTACTGCCAGCCTCAACATGGCGGGATTACCAAGATAGATCTCATT<br>GAAATCAACTACGAGACGGAGGCTAGGTTTCTCTCCATGAACGTATTCAACGGCCTTCGGGCATAGACAAA<br>TTCCCTATCAGTAGGGGTACCTGCATTATTACGAATAAGTACGAAGCCCTCCTTTGGACCCCACGGCATCGTG<br>CCCTCCGTGAAGAATCCCATTCACAAGTATTACCTGGGCGGCAGGAGCATCCCAGCCCCGATCAAAATTACT<br>AGGCATTACGGCGAGAGCGATCTGAATACTATTGCCATCGAGATCCTCGGCCTCACCAAAATGAATTGGAAT<br>AGCTTTGACCTTTACAGCAAGCTCCCTGCGACGATTAACTCCTCAAATCAGATAGCCCGGATCGGTAAGTTG<br>CTGGCGCGCTTTGAGGGCAAGACCTATGATTATAGGCTCTTTATT |
| 206 | 54 | ATGAACCTGACCGTAAACCTCGCCCCATCAGCGTGCAGGGCGACTGCTCAGTCCTGATTGGCAGACAGCGC<br>TACGACGAGCAGAGGCTGGCTGAACTTAGGTCAGACTTTCGGGGCACCCACGTGTTTCGGCGAGACGGTCCA<br>GATAGCATGATTGACATCCCGTGGTCCCGCACGCGCAACCTCTGGGCAACCTGAGGGAGACGATCGACCTT<br>AGGCGGTACCAGCGGCTGTGGCCCATGCTTCTGCAGGAGTCCCTCATCCAGCTGCTTGGTAAGCGCCCCATC<br>CAGTCCAGCAAGCCCTTGAAGTTCCTGGGAGCTAGGTCTCCTCTGATCGAGCACCCGGATCTCCCTGAGTGG<br>TTGAGGCGGGTGAGCGTTACCGAGATCCACACCCGACACATCACCGTGGACGGCAAGCAAATCTACGGTATC<br>GTGTGCGATGTGAGGGCCAAGTCTTTTATCCTCGCCACCTGCAGCGAACTTCTGAAATTCGGCGTGACCATC<br>CTTGGTAGATACGTCCAAATAGAAACAGCCCGCGATAGACGAGAGAACCATGCCTAAAAGGAAGCTCATCGGC |

TABLE 18-continued

Argonaute and helicase DNA sequences

| SEQ ID NO | Argonaute # | Sequence |
|---|---|---|
| | | AGGGTAAGGTCCATCCAAGGGGATGATCTGCTTCTTGACGACTGTGAGGCCGGCTTCGAAAAAGTCGCTGCG
AATGAGGCATTTCTCGAGCCGCGGAAGGAAAATTTCGAGGACTGCGTGAGGCAGGTGCTGAAGCGGGACGCC
GAGAGGGTGTTGGAGAGGTCAGCTCGCGCCAGCCAAACCTGGCCGCAGGCCCTGGGAAACTGGAACACATC
GACGGAATCATCAGGTATCTTAGGGAGAAGAAGCCCGCAGCGGTGCCCGGCTGCCATTTCGTGATCGATGCC
ATGCTCAACACAAACGGCCACATTTTTCCACCCGGGGAAACAATGGACAAACCCTTCCTCTTGTTCGACCCT
AGCGGTTCACGGAGAGAAGACTGGCCCGAGAAGGGCCTTAAAGATCACGGCCCCTATGATGAGCAGGTGTTT
TCCCCCAAGTCCCTGAAGATCGCTGTTGTGTGCCAAAGCCGGTTGGAGGGCAGAGTGGACGAGTTTCTGGCG
AAGTTTCTCAATGGGATGCCGAAGGTCTTTCAACCCGGCAAGAGCTTCGCCCGCTACGGCGACGGATTCGTG
AAACGATTCAGACTGAACAAGCCCGAGGTGCACTTCTTTCTTGCAGATGGCAACTCCGACGAGGCATACGCC
GTGGCCAGCCGCGAGGCACTCGATAAAGCGAGGGATAGCGGGTTCGAGTGGGACCTGGCGATTGTGCAAATT
GAGGAGGAGTTCAAGTCACTGGCCGACGGCTCCAATCCCTACTACACCACTAAGAGCATCTTCTTGCGGAGG
GACGTTCCGGTGCAGAGCGTCAGGCTGGAGACCATGAGCCTGTCAGATAATGACCTGGTGTTCCCCATGAAC
CACCTGAGCCTCGCTACCTACGCCAAGCTGGGGGGCACGCCCTGGCCTCCTGGCTAGCTCACAAACCGTGGCG
CACGAACTGGTGATCGGACTGGGTAGCAGCACCAGCTCCGAATCAAGGCTGGGCAGCCAGATGAGACATGTG
GGAATCACCACCGTGTTCAGCAGTGACGGCAGCTACCTGCTTTCTGATAGAACCGCCGCAGTGCCCTTCGAG
CAGTACCCACAAGAGTTGAGGAAAACGTTGCGAAAAACAATCGAGGCCGTCAGGGCCGAGGACAATTGGCGG
AGTAGCGACAAGGTGAGGTTGGTATTCCATTCATTCAAGCCGTTCAAGGACAGCGAGGTAGAAGCCATAGAG
GCGCTGACCACCGACCTGGGCCTGGGCGACGTGAAGGCCGCCTTTCTGCACATTGCGCCCGACCACCCGTTC
CTTATCTTCGACCACGACCAAATGGGCATCGCCGCACGAGGGGGCAAAAAAGGCGTGTTGGGCCCTGCTAGG
CAGTTGCACATCCGGCTTAGCGACGCTGAGAGCCTTGTGGTCTTCGCAGGGGCCAGCGAGCTTAAACAGGTG
ACGGATGGTATGCCGCGACCCGCGCTGCTCAAGCTGCACCCCAAAAGCACCTTCAAAGATATGACCTACCTG
GCAAGGCAGGCCTTTGCCTTTAGTGCCCATAGCTGGCGGATGCTGTCCCCCGAACCTTTCCCAATTACTATC
CGCTACAGCGACCTGATCGCCGACCGCCTGGCGGGACTCGCGTCTGTTAAGGGCTGGGACCCCGATGCCGTG
ACGTTCGGCGCTATCGGTCACAAGCCTTGGTTCTTG |
| 207 | 23 | ATGATAATGAGCCTGGAGAGCAATATCTTCACTTTTAGCAACCTCGGGACACTTACCACGCAGTACCGACTG
TATGAGATCAGAGGCCTGCAGAAAAGGCACCAAGAGTACTACCAGAACAGGCAAATCCTGATCCACCGACTC
TCCTACCTTCTGAAAAATGCCGTAACTATCATAGAGCGCGACGAGAAACTGTACCTTGTTGTAGCTGCCGAT
GCCCCGGAACCACCCAATAGTTATCCCATCGTTAGGGGCGTCATCTACTTCAAGCCCACCGGCCAGATTCTG
ACCCTGGACTACAGCCTCCGAACACCCCAGAACGAAGGAGATCTGCCAGAGGTTCCTCCATTTCATGGTACAA
AGTGCCCTGTTTCAAAACGCGAATTTGTGGCAACCCAGCGCCGGAAAGGCTTTCTTCGAGAAAAAGCCCTCA
TTCGAGTTCGGATCAATTCTGTTGTTTCAGGGATTTAGCGTTAGGCCCATATTCACCAAGGACAAGATCGGC
CTGTGTGTAGACATCCACCATAAATTCGTCAGCAAAGAACCCCTCCCTAGCTACCTGAACTTCAACGAGTTC
CAAAAATACAGAGGCGTGTCATGCATCTACCATTTCGGCCACCAGTGGTACGAGATCCAACTCTCTGAACTC
TCCGAGCTTAACGCGACGGAGGCAATGGTACCCATCGAGAATAAGTTCGTGACCCTTATTAACTACATCACC
CAGCAAGCCAGGAAGCCCATCCCGGAAGAGCTGGCAAACGTGTCACAGGACGCAGCCGTCGTGCACTACTTT
AACATCAGAACCAGGACAGGATGGCGGTGACGAGTCTGTGCTATCAGGTTTACGACAACTCTTATCCAGAA
ATCCGAAAGTACCACCAGCACACCATTCTGAAGCCACACATCCGCCGCAGCGCGATCCACGGAATAGTGCAG
AAGTATCTCGCGGAGCTCAGGTTCGGCGACATAACCCTGAAGGTATCAACTATCCCCGAGCTGGTGCCCCAG
GAGATGTTCAACCTGCCCGACTATTGCTTCGGCAACGATTACAAACTGAGCGTGAAAGGAAGCGAGGGCACA
GCCGAGATTACCCTCGACCAGGTCGGGAAGCAGCGCCTTGAGCTGCTGAGTAAGGCTGAAGCTGGTATCTAC
GTGCAGGAAAAGTTCGACCGCCAATACATTCTCCTGCCCCAAACCGTGGGGGACAGCTTCGGGAGCCGGTTC
ATCGACGACCTCAAGAAGACCGTGGACAAGCTGTACCCCGCTGGAGGAGGGTACGACCCGAAGATCATTTAC
TACCCCGACCGAGGTCTCCGGACCTACATCGAGCAGGGTAGGGCTATACTGAAAACAGTTGAAGAGAACGAG
CTGCAGCCCGGCTACGGTATCGTAATGCTTCATGACAGTCCGGATCGACTGCTCAGACAACACGACAAACTC
GCAGCTCTGGTCATTAGGGAGCTGAAGGACTACGATCTGTACGTGGCCGTCATCCACAGCAAGACCGGGAGG
GAGTGCTATGAGTTGAGATATAACAACCAGGGCGAGCCCTTCTATGCAGTAATACATGAAAAACGGGGGAAG
CTCTACGGCTACATGAGAGGGGTGGCGCTCAATAAGGTGCTTCTCACCAACGAGAGGTGGCCCTTTGTGCTT
TCTACCCCCTGAATGCGAACGTGGTGATCGGAATGACGTCAAGCACCACACCGCCGGTTACATAGTCGTC
AACAAGAACGGGAGCAGGATCTGGACTCTGCCCACGATCACGAGCAAGCAGAAGGAGAGGCTGCCCAGTATC
CAAATAAAGGCGAGCTTGATCGAGATCATCACTAAGGAGGCCGAGCAAACAGTAGATCAGCTGCACAACATA
GTGATACATAGGGACGGACGAATACACGAAAGCGAGATCGAGGGCGCCAAGCAGGCGATGGCCGAGTTGATT
AGCAGGTGTACGCTGCCTGTGAACGCCACACTCACGATCCTGGAAGTGGCGAAGAGCAGCCCCGTTAGCTTT
AGGCTGTTTGATGTCTCCAATACCAATTCTAAGGACCCGTTTGTGCAAAACCCACAAGTCGGGTGCTACTAC
ATTGCCAACAGCACTGACGCCTACCTGTGTAGCACGGGGAGGGCGTTTCTCAAGTTTGGCACCGTGAACCCC
CTGCACATAAGGTATGTGGAAGGTACGCTCCCCCTTAAACTGTGTTTGGAAGACGTGTACTATCTGACAGCC
CTGCCTTGGACGAAACCCGACGGGTGCATCAGGTACCCCATTACCGTAAAGATCAACGACAGGAGGCTTGGG
GAGGACGCCAGTGAGTACGACGAAGACGCCCTGCGCTTCGAGCTGTTCGAGTCTCTCGAGTCCGAGGATGAC
TTTGACGAGATGACCGACAGCGACTTTAATCAGGAGGAGACAATGGTG |
| 208 | 16 | GTGGGCGACAAGACCTTCAGCTTCAAGGTGTATAGGAAACTGAAACAGCAGAACGACACCAAGGAAGACGAG
ATATACCTTTACAATTTGCCCCAAGGCGAGACCCTGAATGATTACAAGCCATATTGGATCAGTTTTACCCCG
AAGGACGGATTCGAAGAATACATCGCTAATTCTTACTTGAGCATCGGCCTGTCAAAAAAGTACCTGTTCAAT
AGATTCGTGGAGACGCTCAGCAACTCAAAACTGCACTTCACCTACAAGGTCAAAAGGAAATTCACCGACTGG
TACGTCGATTTCGTAATCGCGCAGTACAGCCAGGGAGACAGGATCATCTACATGAGCCCCTACTTCCTGGAA
GAGCAAAACACTACGGCTTCATCATCGACTTCAAGTTCAGCAAGAAGGATGGTATCCCCTTCGATAAGGAG
GTGCAAAAGCTGTCCCTTTCACTGGATAGCAACGGCCGCAGCAACAAAACTATTACTCTGACAAATTTAGG
CTGGTGAACAATTTCATTAAGGAGATTTACACCTCCATAAAGAACATCGGGACCAGTAATAATCCTATCACC
ATTTCCAGCAACCTCATAGAGACCACCGTGTTCCACCTGAACAAGAAGAGTACATCTTTAGCAATAACAAC
GTAAGCTCTAGCCAGTTCCAGGGCGGTGAGGAATTTCGGTGTCTATAAGAATATCCCCCAGGCGTGATCTTC
GCGTTCATATTCGAGGATAGGTTCAGGAGCTTCGCCAACGAGCTGTATCTGAGCCTTACCGGAAAATTGAAC
CCCGGGACCTTTCCCGGACTGGAGCAGATGTTCGGCATCAGCATCAACACCAAAACGTGAGACAGATCAAG
TTGGAGAACTACTCTCTGGATTCAATGCTTAGGGTGGTGAATGACGTGAAGAGCTTGCAGGAGAACAATCCC
GATAAGAAGATCGTGGGAATCTACGTGGAAGACTGCACCATCGACAGCGAGGACATCCCTGCTCCAACAAC
TACTACTTTCTGAAGTATCACTTTATCAAAAATGACCTGCCACTGCAGGTTGTGAATTATCGGAAGCTGGGC |

TABLE 18-continued

Argonaute and helicase DNA sequences

| SEQ ID NO | Argonaute # | Sequence |
|---|---|---|
| | | GAAAGGAATTCTCTGAAATGGAGTACCTCCAACCTGGCCCTGGCCATGTTCGCAAAGATGGGCGGCATCCCC<br>TGGGTCGTAAAACCGTCTAATAAGAACTGCTTGATTCTTGGCATCGGATCTAGTCATAAGATAAACCGGGAG<br>ACCGGCGATATACTTTAAATACTTTGCATACACCATATGTCTCGACTCCAGTGGCCTGCTGTACAAGGCCCTTGAG<br>GTGCTGGCCGACGAGGAGAGCGAGGTGAGCTACCTTGAGAAGCTTACTGCCAATCTGGTCGCCATACTGAAG<br>GAACAAAAGACCAATTACGGCACCTGTGTGCTGCACCTGCCCTTCAAGATTAAGAAAAAGAGGTAGCCGCC<br>ATTAGTGATGCCATAAAACAAATCAACGACATCGAGCTGGTGGTGGTAAAGATCAATGTGGATAACAAGTAT<br>TTCGGATACTCCTTCCACAACACATTGGTGCCCTACGAGAGCAGCTTCGTGAAGCTTTCTAAGGATGAGTAT<br>CTGGTGTGGTTCGAGGGCCTGCTGTACGGCAAAGAGATCGTAGATAAGAGGTTGAGCAACCCCGTGCACATC<br>CAATTCTTGAACATCACCAACAGGAAGAACTTCGATGAGCAGGCGTTTCTGCAGGACATTCTGAATTTGAGC<br>GGAGCCAACTGGAGGGGCTTCAACGCCAAAAGCATCCCTATCTCAATTTACTATTCTCAAATCATCGCGAGG<br>TACACCGAGGCCTTCGAAAACATCGACGGTTACAAGGAGGGTACATATCTCTAACGACAAACCCTGGTTCCTG |
| 209 | 53 | ATGAGCGTGGCGATCGTGAGCCCCCAAATGTACAAGAGTCTGAGCGAGGTGTTTCCTCTGACCGCCTCCCAA<br>CTGAACTTTATGTGCTTTAGGCTGACTCCCGAAATCGAAAAGAAGGATGGTAATAGGCTCAGCTACCATTTC<br>AGTCTGAAGCTGCCGGAAACTGTTGTGATCTGGCACCAGCCCTACTTCTGGGTGTTGGCGAGTAGTAACAGG<br>CAAATCCCAATAAGGACGAGTTGCAAGAAACTCTGATAAGGATCCAAAACGAGGTGGATGACTTCAAAGAA<br>CGACTCTTCGGTTTCCAGAGCGTTCGCCACCCCCAACTCACCCCCTTTATCATCAGCCTCTTCGCCGTGCAG<br>GTCCTCAAAAAAACAAAGTTCGACTACCCCATTGCATTCAGCAACAACGGTGTAATCGTCAGGAGGGAGCCC<br>GACTTTTGGACGGAGAGCATAGAGCTTCAAGACAGCCTGCATCCTGCCCTCACGCTGACCGTAAGTTCATCA<br>ATAGTGTTCCGCGACAACCTCGCGGAGTTCTATGAAAAACATCATCAAAGGGAGAAGCCCGAGCAGTTTCTG<br>ATCGGCCTGAAGGTGCAGGAAATAGAGAGGGGCAACAATGCGATCATCGTGGGACTCGTCGGCACCATCGGC<br>GAGCACCGGGACCAGCTGCTTGAAAAAGCAACCGGGAGCACTAGCAAGCAGGCGCTGCGAGAGGCACCGGAC<br>AACCAGCCGGTGGTTGCGATACAGTTCGGCAAGGATACGAAGCAGTTCTACTACGCAATGGCCGCGTTGCGG<br>CCGTGCGTAACCTCAGAGACGGCAAACCAGTTCGAGGTAGAGTACGGTAAGCTCCTGAAAGCTACAAAGATA<br>AGCCACCAGGAGCGAACCAACCTGCTGGCCTCATACAAGAAGACGGCCCAGGAGTCATTGGCCGCTTATGGC<br>ATCCGCCTGGAGCTGAGTGTGAATAGCAGGGATTACCCCAGCTTCTTCTGGCAACCCCCGTGAAGATCGAA<br>GATACCAAACTTCTGTTTGGCAACGGCATAACCGGCAAGCGGACTGAGGTGCTCAAGGGGCTTTCTATAGGG<br>GGCGTGTACCGACGCCACGGGAAATTCCAGGACAAGTCAAAAGTGATCCAGATCGCGCTCTTAAGCTTTGC<br>GACGTGACCGTTAGCTTGTTCCTGAAGCAACTTACTCAAAGGCTGGCAAAATACGGCTTCCGAAGCGAGATA<br>ATCACCAAGGAAGCCTCTGTCAATCAAGAACCTTGCCACCGCCGAAGCCAGGGCTGCTGTTGAGAAAGCGGTC<br>AATGAGCTCGTGGAAATACCCCACGACATCGTGCTTGCCTTCCTGCCTGAGTCCGACAGGCACACCGACGAC<br>ACGGATGAGGGTTCCTTCTATCACCAGATCTACTCCCTTCTCCTCAGAAGACAAATAGCCTCACAAATTATC<br>TACGAGGACACCCTGTCCAACTCTGGGAACTACCAGTACATCCTGAACCAGGTCATTCCGGGGATCTTGGCG<br>AAACTCGGGAATCTGCCCTTCATTTTGGCGGAAAGCCTCGATATAGCGGACCACTTCATCGGACTTGACATC<br>AGCAGAATCTCTAAGAAAACGCAGGTCGGGACACGAAAGCGTGCGCCAGCGTGCGACTTTACGGACGCCAG<br>GGTGAATTTATCCGCTACCGGCTTGAAGACGACCTGATCGACGGCGAGGCGATTCCACCCAAGCTGCTGGAA<br>AGGTTGCTGCCTGCGACCGAGCTTGCGAATAAAACCATACTGACTTCTACAGGGACGGGAGCTTCGTGGGCAAA<br>GAGGCCGACTATCTTGTGGAGCGAGCCAAGGCGATAGACGCGAAGTTTATCCTCGTCGAGTGTAAGAAATCC<br>GGCGTGCCGCGCTTGTATAACTTGGAGCAAAAGACCGTGATCGCGCCGAGTCAGGGACTGGCTCTTCGACTG<br>AGCAGTAGGGAAGCAATACTCGTGACCACCAAGGTGCCCGATAAAGTGGGCCTGGCTAGACCCATCCGGCTC<br>ACAATCCACGAAAAGGGCCATCAAGTAAGCATCGAATCCGTGCTGGACATCACTACACTCAAGCTTACTCTTCTT<br>CACCATGGCGCGCTGAAAGAACCGCGACTGCCCATGCCCCTGTATGGGAGCGACAGGATGGCATACCTCCGG<br>CTGCAGGGGATACGGCCTAGCGTTATGGAGGGCGACCGCCAATTCTGGCTG |
| 210 | 88 | ATGGAAGAAAATCTGTATCTTGAATACGACGCTTTCTTGAGGAGTGTGAAGCGCAACGTGGACGTCCCTCAT<br>AGTTTCTTGCTTGGAGCCGGAGCTTCCATCTCCTCCGGAATTCAGTCTGCATACGACTGTATATGGGAGTGG<br>AAGAGAGATATCTACATCACGAAGAATATAAACGCCGCCGAGTACTATAAAAATCATAAAAACGAAACGGTT<br>CGCAAATCAATACAGAAGTGGCTGGACAACCATGGCAACTACCCCATCCTGGATGCAGCAGAAGAGTACACA<br>TTTTACGCCGGAAAAGCTCATCCAATCGCTGACGATAGGAGAAAGTACTTCTTTTAGTCTGATTGAGAATAAA<br>GAACCATATATCGGTTACAAATTGCTGTGCTTTCTCGCTTCACAGGGGATTGTAAAGAGTGTATGGACGACC<br>AATTTTGACGGGCTGATTGTACGAGCTGCTCACCAGAATAATTTGACGCCTATAGAAATCACCTTGGATAAC<br>GCGGAGCGCATATTCCGAAATCAGAGTACTAAGGAGCTTCTCTGCATAGCTCTGCACGGTGACTACAAATAT<br>AGCACCTTGAAGAATACTGATACCGAACTGGATAACCAACACGAAATTTTTCAGGAGCACCTCGGAAATTAT<br>CACGTAGATAAAAATTTTATAGTAGCTGGTTATAGTGGACGCGACAAGTCTCTGATGGATGCACTCAAGGCC<br>GCTTATTCCAAGAAAGGATCTGGTAGGTTGTATTGGTGTGGCTATGGTGAGAAGATAAATTCTGAAGTGAAA<br>GATCTTCTTAAGTATATTAGAGCGAGTGGGAGGGAAGCATACTATATAGCTACGGATGGGTTTGACAAAATG<br>CTCATACACTTGTCAAAGGCAATATTTGAGGATAGCCAAGAGCTGAGTGAAAAAATCCAGAAAATACTCGAA<br>AGCACGAATCAAACCGAGACCTTCAACACAGAATTCAAGTTGGAGTTTAAAAAAACCGACAAATATATCAAA<br>TCAAATCTGCACCCTATTGTTTTTCCTAAGGAAGTATTTCAGTTGCAGATCGAGTATGGCAATGAAAAACCG<br>TGGTCCTTCCTGAAAACACTGACAACTCAAACGAACATTAGCGCCGTACCGTTCAAAGGCAATGTCTACGCA<br>CTTGGTACGCTTAGCGAGATCAATTCCATCTTCAAGCCGTATCTTAAAAGCGAGGTCAAGAGGGAAGCGATC<br>AGCCGATTCGACATCGAAAACGTCACCGCATTCAAAAACCTCATGTTGACAGCCATATCCAAATATTTTGC<br>TACACGAAAGAAGTGAACTCTAACTACAAAGATAAGATTTGGTTGAAAAACATCCTGTCCAAGGTGGGGGAT<br>ATCACTGTTCACAAAGCAATTTTCATATCCCTGTACTTTGACAAGAATTCCCATTTTGGTTATATGGCGTTC<br>GCTCCTACCGTTTATTTGGATTCCGACTGCGAAATTGAGAAGAGTCAAAAGCAATCCATCAGTAAGAATTTG<br>CTTGAGAAGTTGTATAATAACAAATATAACGAAGAGCTCGAACTGTGGAATGGTATCTTGTTTAATCATAAG<br>AAAGTGAAATTTGAATATCCTCCCTTGTCTGGTACGGGGTTCGAATTTCAGATATCAAGCAACACTGCCTTC<br>GGGGAGATAGACGTGATTGATAACAAGTACCGCTCTTACGTCCCCAGAATTATGATAATAAGCAGACTCAG<br>TTCCGGGGAATCCAGTTTTTGGAGCCGCAGCTGATATTTAAGAACATCGCAACGAACTCTGACTTCAAGGAT<br>TATCATCCCATGCGAGGACTGATTAACAACCGACCATATGATGTAAATCTCAACGGGATTATCACTCCTGAT<br>GAAATTAACCTCTCAATCATCGTAGCCAAAAGTATGGAGAAAGGTTGTTCGCATTCTTGACACAGCTCAAT<br>AGTAAGCACAGTACAGAAAATATCAACACTGACTACCTGATAGATTACCCCGGCTTCCTGTCCGCCTTTAAT<br>CTGCCCATCAACATCCCAGCCACCAACGATGACGCTAGCTGGATGGACATCAACTTCGTAGCAGATAACTCT<br>AAAGAAACACACGAGAACGCTATACGACTCGCGAGGGCAATTACCAATAAGATCGAGAAGATTCTGCTATA<br>CAAAGCGCCAGCACTATAGTAATCTTTATACCCTTTCGAGTGGCAGCCCTTCGAAACATATATTAACGAAATA |

TABLE 18-continued

Argonaute and helicase DNA sequences

| SEQ ID NO | Argonaute # | Sequence |
|---|---|---|
| | | GAGACGTTTGATTTGCACGACTACATTAAAGCGTTTAGCGCCAGCAAGGGGATATCAACGCAACTTATTCGG<br>GAGGACACCCTTGACGATAAGCTCAAGTGCCAAATATACTGGTGGTTGTCTCTTTCTTTTTACGTGAAGAGC<br>CTCAGGACCCCATGGATATTGAACAACCAGGAGCGGAAAACAGCTTATGCCGGAATTGGGTACTCCATAAGC<br>AAGGTAAAGAACAAGTCAGAGATCGTGATCGGATGTTCACATATATATGATTCAAATGGCCAAGGCCTTAAG<br>TATCGCCTCTCAAAAATTGATAACTACTTTCTCGATAAGCAAAATAATCCGTACCTGTCTTATAAGGACGCT<br>TTTCAATTTGGGGTTAGTATCAGAGAGCTCTTCTATCAGTCACTCGATTCTCTGCCAGAAAGGGTCGTCATC<br>CATAAAAGGACAAAATTCACCGAGGATGAGATCAATGGGATAAAGGCTTCACTCAACCAGGCTGGTATTAAG<br>AAGATTGATCTTATAGAGATCAACTACGATATAGATGCAAAATTCGTTGCCATGAACGTGTTCGATAACAAA<br>TTGCAGGTCGATAAATTCCCGATATCCAGAGGAACATGCATTGTGACAAATAAACGGACGGCGTTGTTGTGG<br>ACGCATGGTATAGTACCTTCAGTTAAGCAGCCCAATTATAAGTTCTACCTGGGCGGGCGCTCTATCCCTGCG<br>CCCATAAAGATTACCAAGCATCACGGAGAAAGCAACATTGATGTGATAGCTAGTGAGATCCTCGGACTCACA<br>AAAATGAATTGGAATAGCCTGGATCTCTACAGTAAACTTCCCTCTACGATAGATTCTTCTAACCAGATTGCT<br>AAGATAGGAAAACTTCTGTCTCGCTTTGAGGGCCGCTCATATGACTACAGGCTGTTTATT |
| 211 | 17 | ATGGACAATTTGGCTCTCTCTGCGCTTCAGCTGGACAGTAGATTGGATCACTGTATGGTATATCAATACAGG<br>ATCGTGTACCATAAGTTCGACGAAACAGAGGCGGGTGAAAAACTGGCAAGAAAGGCCGCCTACGAACTGTGG<br>AAGGTAAACAACTTCGGACTGCTCACCAACCTGGGTGCCAGTAGCATCCTGTCCCTTAAGAGCCTGAGTCAG<br>CTGTCTATCGATTCACCGCTGTTGCAGGCAAGTTTGAAAGCTGACGGCCAGTTGGAGCTGGATTGCGGTAAC<br>GAACAGCATCAGGAGGCGCTGCAGAGACTCGTGAACCAGGACATAAACAAAGCGGCTTGGAACCTCAAACAA<br>GCGAGCGAGGGGAAGCTTGATTGCCGAAAATCACCGAGGCGGGCACGCCGAAATCTTCGAGCCAAGTCACAGT<br>AGTCGGATCAAGGCCCACAGTACCTATTTGGATGCCTTCTGCACCGTAAGGCTGATTCCCGAAGTGCTGTCA<br>GACGGGACAGTGCTGATAGGGTTGCATCTTAAGCACAGCCTGACCGCGAAGGCGGACATCTCTCTTCAGTGG<br>GTCATTGATCATAGGCCCGATTGGCTGATATCCATAGAGAAGGTGCGCCACAGGTATTACGAGCCCGGCAAA<br>GCACCCCTCGTTGCGGAGTTCGTGAAAGTCGATGATTCCATCAACGGATCATCCCTTCTCCCACACTTGGGC<br>AAATCCCTTGTCGCTTACCACCAGGAGAAAGGGCTGCTTTCAGCCGGACAGCTCGCAGAGGCAGCCACCAGC<br>TCACTCATCAAAGTGCGCTACGGACAGAAGGAGGCAGACCACGTTGCTAGCTTGGTGGAACCCATGTTTGAT<br>TTCGATACTCTGTCAAAGATTGACAGCCCCTTCCTGAATAGGCTCGCCAAAGACCTGAAGTGGAGCTTGGAC<br>GATAGAATAAGACAAGCGCGGAGATGGTCAAGAGGCTCTACCTGCCCGGGTTTAATCAGAAGTTGGTACAA<br>GTTGACTACCAGAATCTGAGCAGGAAGAGGTTCAACCACAACCTTATGCTCCAGTTCGCGGATGGGGCAAGG<br>AGCGGCCATGAACAAGACGTCCTGAAATACAAGGCTTTCGCCGACATGACCAGGGCTAGGGTAATCCCACTC<br>GTGGTAGGAGAGAGGAACAACACCGAAAGCAATAGACAATTGCTCCGGAACGCCTATAACGCACTGAGGCAA<br>CTTACCAAGGCCGAATTGCCCCCCTTGCACGTCATTTCCCCCAGCATCGGAAACGCCGACGAGTTGGACGCA<br>CGGCTGCACAAGAAATGTCCCGACAACGCCATCCTGCTTATCGGGCTCACAGAGAAGAGTGACAAAGCCGCG<br>ATCAGGGACACGGCGTTCAACTACGGCCTGGCCACCCAGTTCATGAGGCTCGATCACAAGCCCAAGGTTTAC<br>GACAGCTTCTACTTCAATAACGTCGCAGCGGGCCTGTTCTCCAAGGGAGGAGGGCAACTGTGCGCCGTGAAC<br>GACATGCCCGGTGAGACTGAACTGTTTATCGGTCTGGACATGGGCGGCGTGAATGTAAGGGCGCCAGGTTTC<br>GCATTCCTGTTTCTCAACTCTGGCGCGCAACTGGGCTGGCAGTGGCTGACAAGCAGCAGGGCGAGAAAATG<br>CAGGACGACGCTCTCAGCAATCTGCTGGAGAAGTCTCTCAAAACCTACCTGAGGGAGCACCGACGGGCTTTTG<br>CCAAGGAGGATAACTCTGCACAGGGACGGCAGGTTTTACGAGAGCATCAATGTGATAGAACAGTTTGAGCAG<br>AAGCACGGGGTCAAGCTCGATGTTCTGGAAGTCTTGAAAAGCGGAGCCCCGGTGCTGTACCGGAGAGAACGC<br>AGTGCGGACGGTAAGAAAGTTTTCAGCAACCCAGGGGTTGGCGATGCCGTCTTCCTTAGCGACAGGGAGGTC<br>ATTCTTAGCACTTACAGCGGCGAGGAACTTGGGAAGTCATGGGGTAACAAGGTGAGTGTGAGGCCACTTCGA<br>CTCCGAAAGAGATACGGCGAGACCGCATTGAGCGTGTTGGCCCATCAGGTGTTGGTCCTGTCTAGGATCCAT<br>GGGGCCAGCCTCTACCGACACCCCGACTTCCGGTGACCACCCACCACGCGGACAGGTTCGCAACCTTGCGG<br>CAAGATGCGTGCATAGACGCACTTAGTAAGATGGATAGACTGTGTCCGGTGTATCTG |
| 212 | 37 | ATGAATAACGTGATGCAGGAGTTTCCCGTCGCAAGCTTCCCCACATTCTTGTCCGAGATCAGTCTGCTTGAC<br>ATCACACCGAAGAACTTTATCTGCTTTAGGCTCACCCCGAAATCGAGCGCAAGACCGGTAACAGTTTTAGC<br>TGGCGCTTCAGCCAAAAATTCCCTGACGCCGTCGTGATTTGGCATAACAAGTTTTTCTGGGTACTCGCTAAG<br>CCCAATAGACCAATGCCCAGCCAGGAGCAGTGGAGAGAAAAGTTGCTGGAAATCTGCGAGGAACTTAAGAAG<br>GACATAGGCGACAGAACCTACGCCATTCAGTGGGTTAGCCAGCCCCAAATAACCCCTGAGATCCTGTCTCAA<br>CTCGCCGTCAGAGTGTTGAAGATCAACTGTAGGTTTAGCTCTCCCAGCGTAATTTCTGTCAATCAAGTTGAA<br>GTGAAGAGGGAGATCGACTTTTGGGCCGAAACAATTGAGATTCAGACCCAGATCCAACCCGCTTTGACCATC<br>ACCGTGCACAGTTCATTCTTCTATCAACGACACCTGGAAGAGTTCTACAATAATCACCCCTTACAGGCAGAAC<br>CCCGAGCAACTGCTCATCGGCCTCAAGGTGAGGGACATTGAAAGGAATAGCTTCGCGACGATTACTGACATT<br>GTGGGCACCATAGCGGACCACCGCCAGAAGCTGCTCGAGGATGCCACTGGAGCTATTAGTAAGCAAGCCCTT<br>ATAGAGGCCCCAGAAGAGCAGCCCGTGGTCGCCGTACAGTTCGGTAAGAACCAACAACCCTTCTACTACGCA<br>ATGGCCGCGTTGCGGCCTTGTATCACCGCCGAGACCGCTAGGAAGTTTGACGTGGACTACGGCAAACTGCTG<br>TCCGCCACCAAGATACCCTACTTGGAGCGGAAGGAGCTGTTGGCTCTCTACAAAAAGGAGGCGGGTCAATCT<br>CTGGCGACTTATGGTTTCCAATTGAAAATCAGCATCAACAGCAGGAGGCATCCGGAGCTTTTTTTCAGCCCA<br>AGCGTGAAACTGAGCGAGACCAAACTCGTATTCGGGAAAAACCAAATAGGGGTGCAGGGGCAAATTCTTAGC<br>GGATTGAGCAAGGGTGGGGTGTACAGAAGGCATGAGGACTTCGACGACCTCTCAAGACCTATACGCATCGCT<br>GCGCTTAAATTGTGCGACTACCCTGCGAATTCATTTCTGCAAGAGACCCGGCAACGCCTCAAACGGTACGGT<br>TTTGAGACTCTGCTGCCCGTCGAGAATAAGAAAACCCTGCTGGTAGACGATCTGAGCGGGTCGAAGCACGC<br>GCGAAAGCCGAGGAAGCCGTTGACGAACTGATGGTGAACCACCCCGACATCGTGCTCACTTTCTTGCCGACC<br>AGTGATAGGCACAGCGACAACACGGAAGGCGGCTCATTGTATAGTTGGATTTATTCCCGACTGCTGCGGCGA<br>GGGATTGCTTCACAGGTTATCTACGAGGACACGCTTAAGAGTGTGGAGGCGAAATATCTCCTTAACCAGGTG<br>ATCCCCGGAATATTGGCAAAACTCGGCAACCTGCCGTTCGTACTTGCGGAGCCCCTGGGAATCGCTGACTAC<br>TTCATAGGCCTGGACATCTCCAGGTCAGCAAAGAAACGGGGGTCTGGAACCATGAATGCCTGTGCCAGCGTT<br>AGGCTGTATGGTAGGAAGGGCGAATTTATCAGGTACAGGCTTGAGGACGCACTGATCGAAGGGGAGGAAATA<br>CCTCAGCGCATTCTGGAGAGTTTTCTGCCAGCCGCTCAACTGAAGGGCAAGGTAGTGCTCATTTACAGGGAC<br>GGCCGATTCTGTGGTGACGAGGTCCAGCACTTGAAAGAGAGCAAAGGCTATAGGAAGCGAGTTCATCCTG<br>GTTGAATGCTACAAGAGTGGGATTCCACGACTGTATAACTGGGAAGAAGAAGTCATAAAGGCACCAACTCTG<br>GGACTGGCCCTTAGGTTGAGTGCGAGAGAAGTGATTCTGGTGACAACCGAGCTGAACAGCGCAAAAATCGGT<br>CTTCCTTTGCCTCTGCGACTCAGAATTCACGAAGCCGGTCACCAAGTATCTCTCGAGTCTTTGGTAGAAGCC |

TABLE 18-continued

Argonaute and helicase DNA sequences

| SEQ ID NO | Argonaute # | Sequence |
| --- | --- | --- |
|  |  | ACACTGAAGTTGACCCTCCTCCACCACGGCAGCCTGAACGAACCGCGGCTGCCTATACCACTGTTTGGTTCC<br>GATCGAATGGCCTACCGGAGACTCCAGGGCATATATCCCGGATTGTTGGAGGGGGATCGGCAGTTCTGGCTT |
| 213 | 38 | ATGAACCTGACTCTGTTCAACGAGATCCTCCCCATCAACATCAGCCAACTGCCCAACCAGTACTTCTACAAG<br>CTGTGCACTGCCGGCGACGTGGACCTGGATTCTCTGGGCAGGAGCATCAAGTACCGGATCCAGAAATACTTC<br>AGAGGAATCTGGGTGTGGAGTACCAACGACCAACTCCTCATTTCAGACAAGCTCATCGAGTACCCCGAACTG<br>CAAAAGTTCACCCAGTATCTGTGGACCGACCAGTCTAACCTCACATTCAACCAGCTCGAGGGGATAGAAATC<br>GAGAACATTAGGTGTTGCACCCCCCAAGGCATCGCTGATTTCTGTAGCCAAGGTCTCATCAAAAAGTACGAC<br>CAGCAGATCAAGAAGATACTCGAACAGTCCAAGCAGCACGGAGAGACTATCATATCAAACTGATCCACAAG<br>TTCGGCTCCTGGGTGGTGAACAATCAGCCCTGCATAAGCCTGAGCCTGAAACAGGGAGATCGATTTTAACGGA<br>ACTCTCCAGGACTACCTGACCAAGTTCCCCAACTCTAACATCATCGGCCTGCATGTGCTCGACATCACTAAG<br>CCTTTCAACACCGCACAGGAGGTCATCAAGATTCTCGGTATCTTGGGTGAGGGAAATCGGCGGCAGCGCCTC<br>CTGACTTGGGTCAAGGAGCCAACCATGAAAAAACTCGTGGAAGAGGCCCCAGATAGTGAGCTCGTAGTTGAG<br>ATCGGGAACAAGAAAAAATCCTATCATTACATCATTTCTGCCCTGCGCATCAGAGTCCTCAACCAAGATTAC<br>CTGAGGCTGGGGATTAGCGAGAAGCTGCAAATAGTCAGTGAAGAGAGGTTGAAGTACATCGAGCCACTTTTC<br>CGCATACTGCAATCAGAGGGCTTCCTGGACAAGGTGTATACTAGCCAGCGCAACCCCGAGCTGTTTAGGTCA<br>TGCAGCGAGGAATGGGGTTACAATCCCCTGCTGAAGTTCAAGAATAACGCCACTGTTGCGGCGGAATCCGTG<br>CAGTCCACGGTCCAGGTGGTGCAGAAACACGGCGAATTCAGGAAAGCCGACAAAAGCGAAATTAGGATCGCC<br>ATACTCAACACACTGAAGAGTGAAAACAGCACCAAATTGATTGAGATTTTCCGAAACAACTTTAAGCGAAGC<br>TTTAACCAGAATTTGGAGGGAATCGGTAATCAGCTTAAGTATAAACTCAAGTTGGTGGGCCAGCCCATTGCA<br>CTGGATCTCAGTAAGAACTCCCTCAGCCTGCTGGACAGCAAAATAGGAGAATTGTCTAAAAAGAAGCCGGAC<br>ATTGTGATCTGTGTGATCCCTAACTTCCTTAGCAAGGGCGAAGACGGGCGGACACTTTACGACGATTTGAAG<br>CAGACGTTCCTCAAATACAATCTCCAATCACAAATGTTGCAGGAGAAGACTCTCACGACGTCATTTGCCACA<br>AAGAACATCGTGTTGGGCGTGCTGGCGAAAATTGGAAGCGCTTCCCTATATTCTGCAAGAACCGCTGACGTAC<br>ACGGACTTTGTCGTAGGTTTGGACGTGAGCAGGCGACGCAAAAAAAACCTGCAAGGAACCAACAGCGTAGCC<br>GCCATGACCCGAATCTACAGCAATCAAGGCGAACTGGTCCACTATAGCATCCGAGACGCAACCATCGACGGC<br>GAGATCATTCCCAAGAGGATGCTCTACGACCTCTTTCCACTTCACGAATATCAGGGCAAACGCGTGGTGATT<br>CACCGGGCGGAAACTTCCCCGAGGAAGAGCGCCAGGCACTCGAGGGAAATTGCCGAAAAGATTGACGCGAAG<br>TTCTACTTCGTAAGCATTATCAAATCTGGCAATCCCAGGATCTACGGTAGGACCAAAAACGAAGAGGGCATC<br>GGCAGTTATCGCAAGGCACCTAAGGGTAGCATTTTCCTCCTCAGCGAGACGGAGGCCTTGCTTATCAGCAGC<br>GACTTTCCGGACCGCTTCAGGGCCACGCCACAGCCTCTCAGAATTAAGACGTTTGGCAACTTTCCCCTTCAA<br>AGCGCCGTCCATAGCGTTCTGTCACTCACCTACCTGCACTACGGTTCCGAGCGCCCACCGAGGCTGCCGGTG<br>TCTACCTACTACGCAGATAGCATTAGCACTATGGTATCCAAGGGCATTAAGCCCAAGGACGTTGACGGCAAT<br>ATACCCTTTTGGCTG |
| 214 | 25 | ATGCTCCTTAATCATCTCCCAATCGAGTTCTCCAGCGCACAGTTCGCTGGACACGAAATTGCTTATGTCGAC<br>GGCGAGCAGTTGAGGTCCATACGACAGAGACTCACGCGCACGCACTTCGTGTTGAGGGATGGGGACAATGTT<br>CTGCTCTTCCCGTACGAACATGGAACCGCGACCGAGGGAACCAGGCGAACATTCGACACGGGCGTTAATTTC<br>AGCGTAGCCAACGCCCTGGCGCGCAACGGCATGCTTCTGCGATTCTTCCAGCACTCTAGAAGTATTTCCGGC<br>GTCCGACCGGTGAAATTTGTGAAAGACAACCAGAACCTGCTCACGGGTGACGTAGGCCGGTTGTTTGCTATA<br>TGTCCGGAGTACAGTTTCGACATCCGACCCCTGACCTCAAGACGGCAGCCTTGTGAACGGGGTACTGGTA<br>AACTTCTCAGCCCGATTTTTGGTGAAGCCCTCCCTCGACGAATTGATTGCGCAGGGGCTCGACCCACGGGGC<br>CTGTATGTTGTTAAAGAGGCAGAAAGAGAATCACCCTACATCCTGCCGATGTTTAATCGGAGATTGGTAGGG<br>CGGATCCAGGACGTGGTCGGAGGTATCGCCAAGCTGGTGGACGAGCGCGAACAGGACCTCCCTGTACATGAA<br>CTTCATGTCGAGGCCAACCTGGTCAACTTCGAGAAAGTAGGCAGGACACTGCTTGGCCGGGATTACGAGCGA<br>GTGAGTCGACAAGTGCTTCCCACCCTCCATAAGGTGAGCGGCGCAGAGAAACAGCTCGATCGCTTGGTCCAG<br>CTGCTGACGAGCTTCAAAGACCTCCAGGGTGACATCCCGTGTTGCGACGGCCTGACCGTTAGACTGGCAGGC<br>ATACTTACAGATGTGCCCTTCGGCAGTGAGGTGGGCCAATTCCGCAAATTGTCCGCGCCACAGTGCAGCCTC<br>CGCCCAGGGGGAACTATTACGGTGCCGTGGCCCGTGGACGGCAAATCAATGCCAACGGCCCCTTTGATGCA<br>GACGCCTTCAGCAGGAAGGAACCAACAATCGGCGTTCTGTTTCCGGAGCAGCACAAGGGTAGTGTAGAAGAG<br>CTGGCCGCTAAACTCAGAGACGGCGCACCGAGCGATGGAAAGTACCCAAGTCCATTTCCCCAAGGAATGCCC<br>CGGAAGTATAGACTTAGGAAGATGACATATGAGCTGACGCCCACGAAAGTTTCAGGGGACAGGGCCGCAGCC<br>TACAAGAATGCCGCGCTTGCAGCCGCCCAACAAGAGCTTGATCTCGCTCTGGTGGTCATATCTGAATCAGAT<br>AAGGCGTTGCTTGGAGCCGCCAGCCCCTACTACACTGCGAAAGCCACATTGATGAGCAAGGCGTGCCGGTG<br>CAGGCTATTACCATTGAGACTATCAACAGGCTCAACCCCTACACCTTGAATAATCTGGCACTTTCCCTTTAC<br>GCAAAACTCGGCGGGATACCTTGGACCCTGTCAGTTCAACAGCGACTGGTCCACGAGATAATTGTAGGGATA<br>GGGTCTGCGAGAGTGGGCTTCGACCGCCTCTCAGAGCGGGAGAGGCTTGTCGGCATCACGACCGTGTTCTCC<br>GGGGACGGATCATACCTTCTTGGCAATGCAACGACGGAAGCCAGCAGTACCGAATATAGGTCTCGCCTTCTG<br>GAGAGCCTTAGGGCGACTTTGGCAGAGTTGCGAAGACGATTTGGCTGGCAGCGGGGAGATAAATTGAGGATT<br>ATCTTCCACCAAAGCTATAAGCGGTACAAGGAGACCGAAGCAACCGCCGTTAGCGACCTCATCGCCGAACTT<br>GATGAATTCGATGTGGAATTCGCGTTTGTGCAGATCAGTAGCGATCATGACTGGAAGTTGTTCGATGAGAGT<br>GCCACGGCGTTACGTATCAGTCCCGGCAAAAGGGAGCGAAGGTGCCGGAACGCGGAGTCATAGTCCCTCTC<br>GGACCTCGCGCTGCGCTGATCACGTTGGTGGGTCCGCATCAACTGAAAACCGACCTGCAAGGGTGCCCCTCC<br>CCCATACTGGTGTCTATCCACCCGAGCTCAACTTTCAAGGATTTGAGTTACGTGTCAAAGCAGGTGTTCGAC<br>TTGACCTTTATGAGTTGGCGAAGCTTTAACCCAAGCACGCAGCCCGTTTCCGTGAGTTATCCCAACATGGTG<br>GTGGATCTGCTCGGTAACCTGCGGCAAATCCCCAACTTCAATCCCGACATTCTGACGACAAAACTGAGGGAG<br>TCTAGGTGGTTTCTG |
| 215 | 20 | TTGGACAATTACATACTGACCGAGTACAAGGCCGGCATCCACGCCAGCGAGATCAAGATACACATCTACCGG<br>ATGCCCGTCAAGGATCTTGAGAAAATCGACTATGAGTACGGGAAGTACACACGCACCTCAGACAAAAAAAC<br>AGGAAGACGATATCCTTTTACCGCTCTCTGATCGGCAGCTTTGAGAAGCTCACCATCGTGCCCAAGGGATAC<br>GAGAAGTACGAGTATAGATCAATTAAACTCGACCAGAGTGAGGAGTCACTCCAGGAGAGGAAACTGCTGGAG<br>AGGCTGATCTTCGACGGCCTTAGGGACAGCAATAGGAACCACTTTATGAGCACCGAGCAGAGCATCATCGAG<br>AAAGAGCCCATCAAGTCCCTGAGCAAGTGCAAAATCCACCGGGGTATCTACATAGACATCACCGTGAAAGAG<br>AAAGGCGACATCTTCATCGGTTTCGAGCTGAAGCACTCCATCCAGAGCACCCACACGGATTATCAAGGCTCTG |

TABLE 18-continued

Argonaute and helicase DNA sequences

| SEQ ID NO | Argonaute # | Sequence |
|---|---|---|
| | | AAGGAGAAGAAACTGAACAAGGGCGATAAGGTGTTTGACTTTCTGAACAGCGCCCACTACGAGTTCGAGGGG<br>ATTAGCGACAAAACCATCAGCGACCCCCTTCCCGAACTGGGCAACAAGAGCATTATCCAGCACTACAAAACG<br>AAACCCAGCATCTACTGCCACCTCGTGAAAAAACCGAACATGCCCGCCATCCTGGTACGCAGCAAGAGCGGC<br>AAGGTGTATCCTTACCCCCCACAGCTGCTTAAGAAGGAGTGCCTGATGAAGGATGTGCCGGCTAAGGAGCAC<br>AGCTCTATCAAGCTGAACCCCAACGATAAGATCAACTACAGCATTGAGATCATGAAGAGAATCATAGATGCG<br>TTCGAGAACAGGTATTTCCCCATCGGCTTTGAAAAGAACAACCTGAACATCGCCAAGCTCGGATACAGGAGG<br>AGGCTGGTCCCGGATCCCCTGCTGAGGATTGGCAACGGAGCCACCTGCAACCACAGAGACCTCAAGGGTGCC<br>TTCCTTAGGCACAAGATTTATGACAGCGTGAGCTCCCCTATCTACTACCAGCTTCTGCTTGACCAACCCTTC<br>GAAAGGGAGTGGCAGAAAAAGATGAGCGAAGCGTTCATTACGAAGATGGAAAACCGGAGCAGGCAGTGGGGC<br>ATAAAGCTTCAGTGTACCGGGAACCAGATCCTCCCTACCTCTAACCCGTACGCGCTGAGACTGCATCTTAAG<br>GACATCAACCTGGATACCGACATCATTAGCGTGGTCCTGTTGGACGAGACCAAACAAGAAGGCGAGGAGGTT<br>TACTCTACCATCAAAAAAGAGCTGGGTGGCACCAGGGGCGCACATACCCAGGTAATCCTGATCGATAGCCTG<br>AAGAACGAATACACTATCCCCCAGATACTGTTGGGAATCTACACCAAGGCTGGATTGCAGCCCTGGGTCTTG<br>CACCCAGCCGTTGCACGCCGACTGCTACGTTGGCTACGACGTGAGCCATGAAATGGCAGGCACACCACTGGC<br>ATAGTGCAAGTGTTCGGCAAAGACGGGTCACAGATCTTCAGTCAGCCCATTAGCAGCGCGGAGGCCGGAGAG<br>AAGGTGTCAAAGGAGACCATTCAGACTATGGTGATACAGTTCTTTACTATTACCAGAAGAAAGTTGGCAAG<br>ATGCCACAGCACATTGTCTTCCACAGGGACGGCCGAGGATACGTAGAGGAGATAGACTGGATTAAAGACATA<br>TTGAGTAATAGGGACCTCACCAACGGCCAAAGCATCGCTTTCGATTACATCTCAGTGATCAAAGAGTGTGGT<br>CGGCGCATGGCTTACTTTGACGACATAAAGAAGAAGTATGTGAACGTGCCCGGGATTGCCTACCTGGACGAC<br>AACGCCCAAAAGGCCTATCTTTGCAGCACCAATCCATACGAAAAAGTAGGGATGAGCAAACCTATTAAGATT<br>GTGAAGAAGATTGGCGAGATGACCCTGGAGCAGATCGTAGAAGACATCTATCACCTGAGTTTTATGAATATC<br>GACACCGATAGGAAGGTGAGGCTGCCCGTGACTACCAATTACGCCGATAAGTCTTCAACGTTTTTCTCTCGC<br>GGCTATCTGTCATCACAAAAGAAAGGAATTGGCTTCGTA |
| 216 | 69 | ATGGTCGGCGGCTATAAAGTCAGCAATTTGACAGTGGAAGCGTTCGAAGGTATCGGGAGTGTCAACCCGATG<br>CTGTTTTACCAATACAAAGTCACCGGAAAGGGAAAGTACGATAATGTGTATAAGATTATCAAAAGCGCACGG<br>TACAAGATGCATTCTAAGAACCGATTCAAGCCCGTGTTCATCAAGGACGACAAACTGTACACCCTCGAGAAG<br>CTCCCGGATATAGAAGACCTGGATTTCGCAAACATTAACTTCGTGAAAAGCGAGGTTCTCAGCATAGAGGAT<br>AATATGTCAATTTATGGCGAGGTGGTGGAATACTATATCAATCTCAAGCTGAAAAAGTGAAGGTGTTGGGA<br>AAATACCCCAAGTACAGGATCAATTACAGCAAAGAGATTCTCAGTAATACGCTGCTGACACGAGAGCTCAAA<br>GACGAGTTTAAGAAATCAAATAAGGGTTTTAACCTGAAACGGAAGTTTAGAATTTCCCCGTGGTGAATAAG<br>ATGGGCAAAGTGATACTCTATTTGTCCTGCAGTGCTGATTTCAGCACCAACAAGAACATTTACGAAATGTTG<br>AAAGAGGGCTTGGAGGTTGAGGGGCTGGCCGTTAAGAGCGAGTGGAGCAATATCAGTGGCAACCTGGTGATC<br>GAGAGCGTACTGGAAACCAAGATATCCGAGCCCACTAGCCTGGGCCAATCCCTGATAGACTACTATAAGAAT<br>AACAACCAGGGCTATAGGGTGAAGGATTTCACCGATGAGGATCTGAATGCCAACATTGTCAACGTGAGAGGA<br>AATAAGAAGATCTATATGTATATTCCGCACGCGTTGAAGCCGATAATCACCCGGGAGTACCTGGCCAAGAAC<br>GATCCAGAGTTTTCTAAGGAGATCGAGCAGCTTATCAAGATGAATATGAACTACCGATATGAAACCCTCAAG<br>TCATTTGTGAATGACATCGGGGTCATTGAAGAGCTGAACAACCTGAGCTTCAAAAACAAATACTACGAAGAT<br>GTGAAACTGCTGGGTTACTCCAGCGGCAAATAGACGAACCCGTCCTGATGGGGCAAAAGGGATCATAAAG<br>AACAAAATGCAGATTTTTTCCAATGGATTCTACAAACTCCCCGAAGGCAAGGTACGATTTGGCGTTCTGTAC<br>CCAAAAGAATTTGATGGCGTGTCAAGGAAAGCTATCCGCGCATTTATGACTTCAGTAAGGAGGGCAAATAC<br>CACGGCGAAAGCAACAAGTATATCGCGGAACACCTGATAAACGTGGAGTTCAATCCAAAGGAGTGCATATTT<br>GAGGGATACGAACTGGGCGATATCACCGAATACAAGAAGGCGGCTCTGAAACTTAATAACTACAACAATGTC<br>GACTTCGTAATCGCAATAGTCCCGAACATGTCCGACGAAGAGATAGAGAACAGCTACAATCCGTTCAAGAAA<br>ATATGGGCCGAACTGAATCTGCCCAGCCAGATGATTAGCGTCAAGACGGCCGAAATCTTTGCCAATAGCAGG<br>GATAACACGGCGCTTTACTACCTGCATAACATCGTCCTCGGTATCCTGGGTAAGATAGGAGGGGATTCCCTGG<br>GTGGTTAAAGACATGAAGGGCGACGTGGATTGCTTCGTTGGACTCGATGTCGGCACCAGGGAGAAGGGCATA<br>CATTACCCCGCCTGCAGCGTTGTGTTTGACAAGTACGGCAAGCTTATTAACTATTACAAGCCTAACATCCCG<br>CAGAACGGAGAGAAGATTAACACAGAAATACTTCAGGAAATTTTCGACAAGGTGCTCATAAGCTATGAGGAG<br>GAGAATGGAGCCTACCCGAAGAATATCGTGATCCACAGGGACGGCTTTAGCCGAGAGGACCTTGACTGGTAT<br>GAGAACTACTTCGGTAAGAAAAACATAAAGTTTAACATCATCGAAGTCAAAAAGTCAACTCCGTTGAAAATC<br>GCCAGTATAAACGAGGGAAATATCACGAATCCTGAAAAGGGTTCCTACATCCTGCGCGGCAACAAAGCCTAC<br>ATGGTGACCACAGATATTAAGGAAAACCTGGGAAGCCCTGAAGATAGAAAAGAGCTACGGCGAC<br>ATAGACATGCTCACAGCTCTCAGCCAAATATACGCACTCACGCAAATCCATGTGGGGGCGACCAAAAGCCTG<br>CGCCTCCCAATCACCACCGGCTACGCCGACAAGATTTGCAAGGCGATCGAGTTCATCCCCCAAGGGCGCGTG<br>GACAACCGCCTTTTCTTTCTG |
| 217 | 76<br>(Helicase) | ATGGACCGCGAGATCATTGAAAACTTCAACCCCAGCGACCCCAGGACCGAGGGCGAGAAGTATCTGATGGAT<br>AACTTTTCAACCTCCCCCAGGTTTAATGGCTGGACAATATTTGAGCAGCCCCACATCAACTCAATGAAGCCC<br>GACTTCATCTTGCTGCACCCCCACAAGGGCATCATAATCATAGAAGTGAAGGACTGGAACCTCAGCAGCGAG<br>ACATATGAGAACGGCGGTTACATCTGGGGGGAAAACGGCGAGAGGATTAAGAAAAACCCCATCAATCAAGTA<br>GAAAACTACAAAAACTCTATACTCAAGATGGAACTTACAAACAGCATCGAATTTAGTGAAGTGTTCGGCGAC<br>AAATACTTCGCGTGCATAGAAACGGTTGGTATACTTTCACAAAGCCAACAAAATTCAAGCCGAGAACTTCTGC<br>AGGAGGAACAATAACTACACCAAGATCTGGACCAAGGACGAGTTCGACTACATATGCAATATCAATAACAAA<br>CTGAAGGGCAGTTGTCACACCTATGCCCTGAGCTACGAAAAAGCACCCTTGAAGACAACAGAGGTATGCTG<br>AGTAAACTGGTGGAGGAGCTCAAGTGCAATCTCCAGTACAGTGACTACAACTATGAACGACGCCAACCGATT<br>AAGTTGACCTATGAGCAAGAGAAGTTGGCGAGGCTGCAAAAGAATTCAATCAGGAGGTGGAGCGGCGTGGCA<br>GGCGCTGGCAAGTCCCTGAGTCTGGCGCAAAAAGCCGTGAACGCCCTGAAGGAGGACCATAGCGTTCTGATC<br>CTGACCTACAACATAACCCTGAGGCACTACCTGCGCGATCTGTGCTCTCAACAGTTCGGACCCGGCTCCTAC<br>AAAGGCGAGCGCAAGAAGCTGAGGAGCGAGCTGACCATCGTGCACTTTCATGACTTTTTGAGAATCATCATG<br>GCCGAGTACGAGATCGAGGTCGAACATGACGAAGACGACAACTTCACCCAGCACTGGATAAACAAGATCGAC<br>AGTTGCATAAAGGTGAACGGCATCAAGAGCCACCTCAAGTACGACTATATCCTGATCGACGAGGGCCAAGAC<br>TTTGAAGGCGAATGGATTAGGTTCCTGAAGCAGTTCTTCACCGAGGTGGGTGAGATCTTTATCGTGTACGAC<br>AAGGCCCAGGATCTCTACGAGCATGGCGTGTGGATCGAAGACAGCAACCAAATCAAAAACATCGGCTTTAAG<br>GGCAAGCCCGGGAACCTGAAAATCAGTATGAGGATGCCTGAGAAGATGGTGTACCTGGTGCAGGACATCAGA |

TABLE 18-continued

Argonaute and helicase DNA sequences

| SEQ ID NO | Argonaute # | Sequence |
|---|---|---|
|  |  | AATGAGTTCAAGATAGATGAGGAGGAGATCACCCCAAACGTGAACAGCCAGCAGAGCTTCATCGAGATAACC<br>AAGTGGATTAACTGTATGCCCCTGACGCTCACTGAAAAGCTCGACCAGATTGAAATACAGGTGGACTTTCTG<br>CGCCGAAACAACAACAGCCTGGAGGATATCACGATCATTACGACCAACGAGGAGACCGGAGTGGAGATAGTG<br>AATAGGTTCAAAAGCAGGGGTATCAAGACCAGCCACGTCTACGATATGGAGAAGCGGGGGAACCAGGCCAGG<br>CGAAGGATGGAAAATGGAAATTCCAGGGCGGCACCGGCAGACTGAAGATTTGTAGCTATCACAGCTATAAG<br>GGCTGGGAGACTCCGAACATCATCCTTGTGCTGGACGAGCCGAGCACAAAGTATGAAGACGGCATAATTAGT<br>AAGGGGGAGTATAACGAGAAGAACATTTTCGACGCTATCTTCATTAGCATGTCCAGGGTGAAAAGGAAAGCC<br>CAAACCGGTGAGTTTAGCTTTACGTGCCTGAATTATCTTAGCGAATACAATAAGATTGAGGGCCTCTTCCAC |
| 218 | 75<br>(Helicase) | CTGGGGCTGAATAATGAGTCCAAAGAGTTCTTTAAGGGCATTAGCCGCATTTGGAGAAATTACAAGGACTAC<br>ACCTACCTTGACGGGATTAAGCTGAGCCAGGCGCAGATCGATATCATCGAGAAGGAGGAAGACCAATTGCTT<br>ATAGAGGGCTACGCCGGCACCGGTAAGTCCCTGACCCTTATATACAAGTTCATTAACGTGCTGGTTCGGGAA<br>GATGGGAAGAGGGTGCTGTATGTGACTTTTAACGATACGCTGATCGAGGATACGAAAAAACGCCTTAGTTAT<br>TGCAACGAGTACAACGAGAATAAAGAGAGGCACCACGTAGAGATTTGCACATTCCATGAGATCGCCAGTAAT<br>ATCCTGAAAAAAAGAAGATCATAGACAGGGGTATTGAGAAACTGACGGCTAAAAAGATAGAAGATTACAAA<br>GGTGCCGCTCTCCGCAGAATTGCGGGAATCCTGGCTAGGTACATCGAGGGGGGAAAGTATTATAGCGAGTTG<br>CCTAAAGAGGAACGCCTCTACAAGACACATGACGAGAACTTTATCAGGGAGGAGGTGGCCTGGATCAAGGCC<br>ATGGGCTTATAGAAAAGGAGAAGTATTTCGAGAAAGATCGCATTGGGAGGTCCAAGAGTATCAGGCTGACG<br>CGCTCACAACGCAAAACTATATTCAAGATATTTGAAAAGTACTGCGAAGAGCAAGAAAACAAATTCTTCAAA<br>AGCCTCGACTTGGAGGATTACGCCCTGAAGCTCATCCAGAACATAGATAATTTCGATGACCTTAAGTTCGAC<br>TACATTTTTGTGGACGAGGTACAGGATCTCGATCCCATGCAAATTAAGGCGCTGTGTCTGCTGACCAATACG<br>AGCATCGTGCTGTCAGGCGACGCGAATCAGCGGATTTACAAGAAATCTCCCGTGAAGTACGAGGAGCTCGGC<br>CTCAGAATCAAAGAGAAGGGGAAACGAAAATTCTGAACAAGAACTATCGGTCCACGGGTGAGATTGTCAAG<br>CTCGCGAACTCAATCAAGTTCTTCGACGAGTCCATCAATAAGTATAATGAAAAGCAGTTCGTAAAATCCGGT<br>GATCGCCCGATCATCCGGAAGGTGAACGACAAAAAGGGTGCGGTGAAGTTCCTGATCGGCGAGATCAAAAAA<br>ATCCACGAAGAGGACCCCTACAAAACAATCGCCATCATCCACCGAGAGAAAAACGAGCTTATCGGCTTCCAA<br>AAGTCCGAGTTCCGAAAGTACCTGGAAGGCCAGCTGTACATGGAAAAATTCAGTGACATCAAGTCCTTTGAG<br>TCAAAGTTTGATTTGAGGGAAAAGAACCAGGTGTTCTACACCAACGGCTACGATGTGAAAGGGGCTGGAATTT<br>GATGTGGTGTTCATCATAAACTTCAACACGGCCAACTACCCACTGAGTAAAGAGCTGAAGAAAATCAAGGAC<br>GAAAACGACGGCAAGGAAATGACGCTCATTAAAGACGATGTGCTCGAGTTTATCAATCGCGAGAAGAGGCTG<br>CTGTACGTAGCTATGACCAGGGCCAAAGAAAAGCTGTATCTCGTGGCCGACTGCAAAAACAGCAACATCAGC<br>AGCTTCATCTACGACTTTAACACCAAGTACTATGAGGCACAAAATTTCAAGAAGAAAGAGATAGAGGAGAAC<br>TACAACCGGTACAAGATTAACATGGAGCGCGAATACGGCATCATCATTGAGGACGACGACTCCAACAACGTT<br>AAGAACAATGACACGAAACAAGAGAACAAGTTTAATACCGAATCTAAGGAAAAGGGCAAAGATGACATCGAC<br>AAGATAAAGGTGTTTTTCATCAACAAGGGAATCGAGGTGGTGGACAACCGAGATAAGAGCGGGTGCTTGTGG<br>ATCGTCGCCGGGAAGGAAGCGATCCCTCTTATGAAGAAGTTCGGTGTCCTGGGCTATAACTTCATATTCATC<br>GCAAACGGCGGTCGGGCATCTAAGAACCGGCCAGCCTGGTACCTCAAGAATAGC |
| 219 | 14 | ATGAACAACACCATAAACAAAATAGACTTCGGCGCGTTTCTGAGATCATTCAAGCAGAACCTGGACGGTAGC<br>TTTTTCTTTCCTTCGGGAGCAGGCGCGAGTGTGAGCAGCGGCGTACAGTCTGCAAGCGACTGCATTTGGGAC<br>TGGGAAAAAGACATTTTTCTGGCCCAAAACCTTCAATTTGAGGAGTTTCTGGACATCCATAGTGACTTCTGT<br>AAAGATAAAATCCAAAAGTGGTTGGATGAGCAGGGCGTGTTTCCCAAGCGAGACTCAGAGGAAGAGTACGTG<br>TTTTTATGCCGAGAAAGCGTACCCAATGGAACAGGACAGGACCAAGTATTTCGAGAACCTTTGCGCGGACAAA<br>ACCCCCTACATAGGGTATAAACTGCTGATGCTGCTGAACAAATACGGAGTTCTGAAATCCGTGTGGACAACG<br>AATTTTGACGGTCTGATAGAACGCGCAGCGCACCAAGCCGATCTGACGCCCATCGCCGTTACCCTCGACAAC<br>CCCGAAAGGATTAGCCGAAACGAGAGTAAATCTGAGCTGCTCTACGTGGCACTCCACGGTGACTACAAGTAT<br>AGCAAGCTGAAGAACACAGCCAAGAGCTGGACGCGCAAGAAATTCTCTTCACCGAACGCCTGAAGTCTTAC<br>TTCATCGATAAGAATTTGGTGGTGATCGGTTACAGCGGTCGAGACAAAAGTTTGATGCACACCTTGTGCGAG<br>GCTTTTATGCGAAGGGGTGCGGTCGGCTTTACTGGTGCGGCTAACGTAACAAGATTACCTCTGAAGTGCAG<br>AACTTCCTCAACAGAATAAACGATTCAGGTAGGGAAGCCGTGTACGTGGACACCGATGGGTTCGATGCCACC<br>CTCGTGTCTATTATGAAGTTTTGCTACGAGGATCAATTCGACAAGAAAATCGAAATCGGCAAGTATCTCAAG<br>GGCCTGTCAAGGGTGAAGCATATTATCCCTTTCAGCGTTGAGAATACCACGTTCACCGGCTGCGCCAAGACC<br>AACCTGTACCCCTTGATCATCCCCCAAGACATATTCCAGTTCGAGATAGAGAGCCCCGAAGGTAGCAGCAAA<br>TGGACCTTCATTAAAGAGAAGATTAAGGGCAAGGACATTATCGCTGCCCCTTACGAGAAAATAGTCTACGCA<br>TACGGGCTGCCAAACTCAATCTACAACGTATTCAGTAAGGAGCTGATCGGCGAGATCAAGAGGGTTCCCATC<br>AGCCTGAGTAACATCAAAGACAACAGCACCCTCAAGAATATCATCCTGAAGGTGCTGATATGTTCTCTGAGC<br>AGTAACGCGGGACTCAGGGCGAGTATGAGCAAGAAGATCATCTGGAATGAGAAAGAGAGGTTCCAGAGCAAC<br>GTTTTTAAGGCAATAAAGATCGACATCGTTTTCATCAATAGCGAAAAGTACGCCCTCATCTCAATCACCCCT<br>ACCCTCTATTTCAACAAGGAGGGCAACTACACGACGCTGCAGAAGCAGGAAATTACGCGGAGCTACATTGAC<br>AAGCTGTACAATAAGATTTATGAGGAAACCCTTGTTACTGGGAGGCCATCCTGTTTAAGCAGCAGACCAAG<br>ATCTGCTTCGACTACCCGCTCAATTCCGGGAACGGCTGTTTCTTCAAGGTTAGCTCTAACAGGGGCGAAGCC<br>CTGTTCAATAATCCGAATAAGCCGTACGTGATTACTAACGACATCATACTTAAACGCAAAATCTACGAAGGC<br>ATCATAATCGACGAGCCCCTCCTGAACTTCTCAGGGTCAACCAGCGCCCACATCATTATGGACTCCAATCCG<br>ATGCGCGGTCTCAACAACAATAACCCATATGATCACTTCATTGCAAGCAAGTTTAGGGACGTTTCTATCCAC<br>ATCGGAGTCGTGTGTCCCTGTACATATAGCGACAGGTTTTTTAGCTTTCTGAACAGCTGCAAAGTCCGATA<br>AAGAATAACATCCTAACTCAGACTACATCCAGAAGTATATCAGCCAGATATACGCAAGCATTCTT<br>AATATCCCAGCGATCAACAGCCAATACTGGATCTCATGCCGCGAAGAGCAGGATAACAGCATCTCTTTGGCT<br>AGGAACCTGTGTAAATACGCGAACCAGATGGCCACTAACATGCCAGGTATAATAGTTACCTTCTTCATTCCT<br>AACAGCTGGAGCAACCACAAGAGTTTCAAAGAATGTGGCGAGGTATTCGACCTCCACAGTTACATCAAGGCT<br>TTCGCCGCCACAGCACGGTTTTACAACCCAAATCATTGAAGAGCGAACTCTCACAAATCTCTCATGAAAAG<br>GAGATCTATTGGTGGCTGAGCCTGGCGTTCTTTGTAAAGGCTATGCGAGTACCATGGACCCTGGCCAATCTG<br>GACCAGAACACCGCCTTCGCCGGCATCGGCTACTCCTGAGCAAAAAGCAAAGCGGCAAATTCAATATCGTT<br>ATCGGCTGTAGCCATATCTATAATTCTGAGGGCAAGGCCTGAGGTACAAGCTCTCAAAGATAGATAATCCA<br>ATCTTGGACCGGAAAAACAACCCGTACCTGACCTATAATGAGGCGTATAAGTTGGGCGTGAACATACAGAAT<br>CTGTTCATTCAGAGCATGGACAAACTCCCGAAGCGAGTAGTGATCCACAAAAGGATCCCGTTCCTGGAGGAC |

TABLE 18-continued

Argonaute and helicase DNA sequences

| SEQ ID NO | Argonaute # | Sequence |
|---|---|---|
| | | GAGATAAAGGGCATTACCGAGGCGTTGGCCCAGGCCAACATCACGAATGTTGACCTCATCACTATCACGATC
GAAAAGAACATCAGATGCCTGGATCAGTTCTTCTACAATGGTCAAGCCAAGAACAGCAACTTCCCACTGCAT
AGGGGCACCTGCATGAAGCTCAGTGATACCGAGTGTCTGTTGTGGACCCACGGCGTGGTGGACTCAATTAAG
GCGGGCAGGAACTACTACTCTGGTGGCAAGGGTATCCCCTCCCCCTCCGCATATCAAAGTTTTACGGCGCA
GGCTCTATGAAGACTATATGCAACGAAATCCTGGGGTTCACAAAGATGAATTGGAATAGCTTTAACTTCTAT
ACCAAGCTTCCCGCGACCATCGACACCAGCAACACGCTGGCGCAAGTGGGGAACATGCTCGATAATTACAAC
GGTATTACATACGATTACAGGTATTTCATC |
| 220 | 26 | ATGATGGGAGCCAGCGATGAGTATTCCTTTTACGCTGAAAAGGCCTATCCCATAGAAGCGGACAGGCAAAAG
TACTTCGAACAGCTGGCGTACAACAAAGCCCCCTACATTGGCTATAAACTCTTGTGTCTGCTGAATAACGCG
GGGCTGATAAAGTCTGTTTGGACCACAAATTTTGATGGCCTGACGGAAAGGGCCGCTCACCAAATGAACATC
ACCCCCATCTGCATTACCCTGGACGACCCCGAGAGGATTTTTAGGAATGAGAACTCTCACGAACTGCTGTAT
ATCGCCCTTCACGGCGATTACAAATATAGCAAGCTCAAAAATACCACCCACGAGCTGGACACCCAAAACAAT
ATCTTCAGAGACGCACTGAAGCGATACTTCGTGGATAAGAATCTTATTGTCATAGGATACAGCGGCCGAGAT
AAAAGCCTGATGAACGCACTTAAAGAGGCATTTTCCCAATCCGGCTCCGGGCGACTGTACTGGTGTGGCTTC
GGGGACGATATATGCAGCGACGTTAAGGAATTGATAGACATCGCCGGGAGCAATAATCGGATTGCCTACTTC
ATCCCGACGGACGGCTTCGATAAGACCATGCTCCAACTTAGTCGCGCCTGTTTCGAGGACGACATTGTGAAG
CAGGAGGAAATCAAAAAGCTGATCAAGTCCACGATCAAGGAGGACGAGACGAAGACCAGCTTCCGAATCGAG
AGCAGCAGGAACGATAAACTTATTAAGTCTAACCTGCATCCCGTGGCGTTCCCCAAGGACGTGTACCAGTTC
GAGATTAAGACTAACGGCGAGCATCTGTGGAACAACATAGACCAGATCATTGGCGGCAATAAGGACATAGTT
GCCGTACCGTTCAAAGGTAAGGTGTTCGCTGTCTCAAGCATTGCGAAAATCAAGGAGAGGTTCGGGGGCTAT
ATCAAGGGGGAAATATTGAAAGACCCGATTGGCGTCGATGACATCCGCAAAGTATCTGTGTTCCAGCGGCTT
ATGATGAAGAGCATCCTGATTGGAATCTCTGAGTTGGCAAATCTGGAAACTGATGGAAAGTGGCGCCTTTGG
AAAAAGAACACCCTGAGGCGAATCGTAAACGGCACGGAGTATTTCATCGCCGACGCTGTAGAGCTGTCCTTT
TTCTTCGGAAAAGATACCAAGTTTGCCTATCTCAGCATCAAACCGACCATTTACATTTATACACATAGCGAC
GAATTCATACCGAAGGATATAAAGCTGCAATTCACAAAGGAGAAGTTCGACCGACTCTATAATGCACAATAC
GACCAATCCCTGGAGGAGTGGAATAATCTCATCTTCCACAACAACAGCCTGAGGTTCACCTTTCCCGTACTG
ACCACCTCCGACATGAGCTTTAGCATCAGCAACAATGTGGCCTTCTCAGGAATTAAGGTTTTGAGTGACAAG
TATAAGAGCTACCCCGTTTCTATCGAGCAGAAGCGCATAGTTTTCAAGGGCGTGGAGTTCCTGGAGCCCCAG
CTGCTGTTTCAAAATAAGAACAGCAACTTCAAGTCACGCGACTTCCATCCCATGAGGGGATTGATTAACCAC
TACCCCTTCGACTACCAGAACAATGGGATCACCAACACGTTTAATGTCAAACTCGGCGTGTTGTGCTCCTCT
AAGTACTCTACTAGGCTGTACGAGTTTCTCATGAAATTGAATGCCCAACATAAAGCGCCCGAGAAAAACGAG
TACATAATTGCTATGCTGGATTCAACCAAATCTACAACATCCCTATTGAGATACCGCTGGTAAACGACGAG
AAGTGGATGGACGTAAAGTTTAATAGCAGCGTGAGTATCAAAGACGACGCTCTCAACCTGGCAAGAATCATA
TGCACCCAGATCGAGGCGCTTCACGAGTCTTACAAAACTGACATGACCATCGTGATCTTCATTCCCAACGAG
TGGCAACCCTACAGACATATCGAGGAGGACACATGGGTTTTTGACCTCCACGACTACATCAAAGCATATAGC
GCTCAGAAAAGAATTTCCACGCAGTTCATAGAGGAAGATACTCTGAACGATTCATTGACGTGCCAGATATAT
TGGTGGCTCAGCCTTAGTTTTTACGTGAAATCCTTGCGGACGCCGTGGGTTCTGAATGCTAACAATAATGAG
ACCGCTTACGCGGGCATCGGCTACAGTATAAAGAATAACAACGGTGAGGCGTCAATTGTCCTGGGTGTAGC
CATATTTACGACAGCCACGGCCAGGGCCTCAAGTACAAATTGAGCAGAGTGCAGGACTGCTACATCGACAAC
AAGCGGACCCCTACCTGAGCTACAATGAGGCCTCAACTTTGGCATAAGTATCAGGGAGCTCTTTCTGCAC
AGCATGGAGTACCTGCCAAAAAGGGTAGTAGTGCATAAACGCACCGAGTTCAAACCCGACGAAGTGAATGGC
ATTGTCGACTCACTGCAGATAGCGGGTATCGAGAATATAGACCTTATCTCCATCAACTTCGAGCGGGAAGTT
AAATTCATGTCCACTAAATCCAACTACGGGCAGTTGCAAATCGATAACTTTCCCATACGCAGGGGCACCTGT
ATCGTGGTGAACGACTATGAAGCCCTTCTCTGGAACCCATGGAATTGTGCCGAGCGTTAAGTCCGATAACAGG
ACCTTCTATCTGGGCGGACGATCTATTCCTAGCCCTCTTATCATTAAGAAGCATTACGGTAAGAGCGATATC
AACGTTATCGCTACAGAGATACTGGGTCTTACCAAGATGAATTGGAACTCTTTTGATCTCTACACGAAGCTG
CCGGCCACCATCGATAGCTCTAATCAAATCGCGCGGATCGGGAACCTGCTGACTAGGTTCGAGGGCAAGACC
TATGATTACCGGTTTTTCATT |
| 221 | 46 | ATGCGATTGGGGCACATAGGCAACGGCTGTTACAGGGAAGGCGTTAAAGCACAATTCCAGACACGAGAGAGG
GAGGATGCCGGTTCAAGGGCTGCGGCTGCCCAACCCCCGATTAAGCAATTCGGATACACCGATAGACTCGGC
CTGAACCTCGCCCCCATAAGGTTTTCTAGCGAAGAGTTTGAAGCCGGACGGACGGTGTACCGCGACGAGGAA
CAGTACCGAGCTCTTAGGGAAGCCCATCAAGCCACCCATGCCTTTAGGTATGACGCAAGGGACGCGGCTATA
TACGACATCCCTATGGCAGAAGGGTGGCGCCTCTGGGTACTCCCGTGAGGATCAAAACTAAGGACCACCTC
GCTCTGCTCGGCAAAGCGGCTAACCACGCGCTGCTCGATTGGCTCGCACCACGCAGAACCATTCTGCGGAGG
GCGAGACCTCTTCAGTGCTGGGGCAACAGGAAGGCCTCACTGTTGTCAGCCGCCGTGCGGGATCAAGGACTT
GCCGAAACAAAGGGTCTGGATGTTCTGGTAAGGCATTCTTTTGATTTGAGGGCTTTGGGCGCACCTCACCAG
GGTGCTGAACCGTACCTTGCCCTGATGTTGGACGTGAGTACGAGCAATGAGCTGGAGATACCTGTGGGCGAG
CTTCTGCGCGAGAGATTCGACCCCATCGGTCGATACGTTTGTGCCAGAGCCGACTCTGGCCAAGATAACGTA
CTTGCTAGGTTGGAAACACTGGGTAGGGTCGTGGGTGTGGATGGTGGTAAGCTTCAACTGAACGACTTTACC
GGAGAAGAATTCGTGACGCTGATTCAGTCACGTTGGAGCCTAGATTGGAGAATCTCGATGCGCTCATTCGC
CACTTCTATCCCAGGGATGCGCCAAAAATCCTGGAGGGCCTTCGCAAAAGGAGAGTGCCTTTCTCCACCGCG
AACGACAAGCTGGCGAAGATACGAGAAGTGCACGGAGGAGTAGCCGGCCACCTTGAAACGATTAGGATCGCT
GGCATGGCTATAGAGGTGGGTGCCCTGCTGCAGAGAGGCTCTAACCTGTTTCCCCCACTCATAAGCACGGAC
CGGCCTGGATTTCTGTTCGGCGCTCAAGGTAGGGAAGCTGGCGCGTTCCCCGACGTGGGGGTGAAGCAGCAT
GGGCCCTACAAGTACATGCAACACGAGCGCAATGAACCTGTGATCGCCATCATCTGCGAGAGCAGGTTTCGG
GGTCGGATAGACCAACTCGCCCGAACACTTCGCGATGGTGTCGCGGAAGATGCCTGGCAAGACGCGATGAGG
GGCAGAAATAAGGTGCCGAAAACCCCTTTAGAGGCGGGCTGATCGGTAAATTGAGATTGTCTCGGGTGCAG
TTTGAGTTCGAAGAAGTAACCGAGCCCACTCCCGAAGCCTATCGCAAGCCCATCCTTCGGCTGCTTGCGGAA
CTCCCAGAGACACCCGACCTCGCGTTGGTTCAAATACGAGCGGATTTTAAGCAGCTCCGCAACGACAGGAAC
CCATACTTCGCTGCAAAGGCCGCATTCATGACGGTGGGAGTGCCCGTGCAGTCCGTACAAGCCGAGACTGCG
GACATGCAGCCCAGTAATTTGGCCTACATGGCCAACAACCTGGCCCTCGCCGCCTACGCAAAATTGGGCGGT
AGTCCGTTCGTGATCTCCACACGCATGCCGGCGACGCATGAGCTCGTGGTTGGCTTGGGCTACACAGAGGTG
TCAGAAGGACGCTTTGGACCGAAGTCCCGATTTGTAGGCATCACCACCGTGTTCCAAGGCGATGGCAGGTAC |

TABLE 18-continued

Argonaute and helicase DNA sequences

| SEQ ID NO | Argonaute # | Sequence |
|---|---|---|
| | | TTGGTGTGGGGGCAAACTAGAGAAGTAGAATTTGAAAACTACGCCGACGCTCTCTTGGCGAGTCTGAAGACT<br>ACCATCGACACAGTGCGCAAGGACAATAACTGGCAGCCACGCGATCGAGTGAGGTTGGTATTCCACGTGTAT<br>AAGCCCCTTAAACATGTCGAGATCGACGCTATCAAACAGTTGGTGCAGGAGTTGCTGAAGGGCGAACATGAA<br>GTGGAGTTCGCATTTCTGGACATCTCCCGCTTCCACGATTTTGCCCTTTTCGATCCTTCCCAAGAGGGCGTG<br>AATTACTACGCTGACCGCAGACGACTGCTGAAAGGCGTGGGCGTCCCCCTTAGGGGTATCTGCCTCCAACTG<br>GACGAAAGGAGCGTGCTCTTGCAGCTGACAGGCGCTAAGGAGGTGAAGACCAGTGAACAAGGTCTGCCCAGG<br>CCCCTGCGACTGACGTTGCATTCCGAGAGTGATTTTAGGGACCTCACATACTTGGCGCGACAGGTGTACAGC<br>TTTAGCTACCTCTCCTGGCGCAGCTACTTCCCGGCCATAGAGCCGGTGAGCATTACCTACAGCAGACTTATT<br>GCCAATGCACTTGGCAACCTTAAGAGCATCCCGAACTGGAACAGCACATTCTTGACAGCTGGCCCACTGAGG<br>TCAAGGATGTGGTTTCTG |
| 222 | 49 | CTGGAGAACCTCACCATAAACATAATCCCCTTCAAGCACCCCAGCATCCAAAAAGAATTTGGCTTCTATACC<br>GAGAAGAAGGAGGGCTATTTCCCCATTCATAGGACCGAGTTGCCCAACGAGCTGTGGGACAACCAGAAAGAG<br>GAAGTGGTGAAGCACAAGTTCTACTACACGAACTTTGAAGACACGGAGGATTGCGTTCTGAAGACCAAGGTG<br>GACCTGTATAGTAGCACTAAGTTTGCCAAGCATCTGTACACGCGATTGGTGTACCAGTATTTCATTGGGATA<br>GCGGATGCAATCCAGTTCAACTACGTGGGTGACATAGAGGTTTGGCTGCTGGATGCGAAAGCCAGCACCACC<br>AAATACAATAGCTACAACAAGTATACCCTGAAAATAGAGTTTAGCGGTCTGACCAAGAGCCCCGCTCTCCTC<br>CTCAGCTATGACAACACTAGTAAGGTAGCGACTACGAGCATAGACGAAATCAACATTCCCACCGAGTACTTC<br>AAGACCGTCGTGTATAACAAAGAAATCCAGAGGTTCAAGTACCTGACCGAGGACGCGAAACAACACCTCGAT<br>CAAGTGTATCCCCTGCTCAACATACCGTTGAAAAACCATCTTGAGATTCCTCACACCGTTCCCCGCAAGGGC<br>AACAGGTATAAGCCCTACTTTAACCACATTACGACTTTTTACAATAACTATTTGAACACCGACGAATTCAGG<br>GCCATCCTGCCCCTTGATGAGAATGGATTCTTCAATATCCCAGAGGACAGCATTTTGAAAACTAGCAAAAAT<br>TCTAACAACCTCCGGTTCTATAAGAAAGTCGGAGTAGATCCCAAGGCTGGAATGAAGAAGCCCGGTCCCTAC<br>AAGGCCTCCCCCCACGACAACGTGAACCTGTTCTTTATCTATCACAAACCCGACGCACATGAATACGCCAAA<br>ACGTTGCATGACTACTTCATGGAGGGGTACAAAAAGTTCTTTCCCCCCCCTCAAGAACGTTATCCGGCAGCCG<br>CTGTTCCTGGACAAAGGCACCTCACTTGCATTTGAGAGCTTCGACAGCTGCATCGCCGAGCTGAAAACCCAT<br>CTGTTCGACCTCAAAAAAAAGCCCAATACCCGGTACGTGGCCATCTACGTGAGCCCCATCCATAAGGAGGAC<br>GAAGACAATAAACACCTGTATCACCAGGTCAAAGAAGAGCTGCTTAAACATGACATCACCAGCCAGGTGATT<br>TACAAAGAGTCCATCAAAGATAAATACTTCGGCGCTTTCCTCGAGAATATCGCACCAGCTTTGCTTGCAAAG<br>ATCGACGGCATTCCCTGGCGACTGGACAGGGAGTTGAAACAGGAACTGATCGTAGGCGTCGGCGCCTATAAA<br>AGCAGCGTCACCAACACAAGGTTCGTTGGAAGCGCCTTTTGCTTTAACAACAAAGGAGAGTTCAAGAGCTTT<br>GACTGCTTCAGGGAGAAGGAATTCGATCTGATTGCCGGGAAAATCGGCAAGCAGGTGCTCACCTTCATTGAG<br>GAGAACGAGAACAAGTTGGAGAGGCTGATCATCCATTATTTCAAGCCTTTCAACAAGGATGAGGATAGATCTC<br>GTGCAGGAGACCCTCGGCCTGCTGAAGCTGGAAATCCCCATCATCATCGTGACTATCAATAAGACCGAGAGC<br>TCCGATTACGTCGCTTTTGACACCAACGACGACGCCCTGATGCCCCTGAGCGGCACCATTATCGAGATAGCA<br>CATCTGAAGTATCTGCTGTTCAATAACGCGAAGTACAGCAGCATCGGCTTCGCCAAAGACCACCCCTTCCCC<br>GTTAAGCTCAGTCTGTCTGTACTGCACCGACCAGGATTACTTCGAGGACATCGCCATCGTCAAGGAGCTCATAGAT<br>CAGGTTTATCAGTTTTCTAGGATGTACTGGAAGAGCGTCAAGCAGCAAAACCTGCCCGTGACAATCAAATAC<br>CCCGAGATGGTGGCCCAAATCTTCCCACACTTTGAGGGCGATAAACTGCCTGATTTTGGAAAAAACAATCTC<br>TGGTTTCTG |
| 223 | 77<br>(Helicase) | ATGCTGACCAATAATCAGATTGTGCTGGAGCAGGAACTTCTGGGAAGCATATTCAAAAACAATAACCTGATG<br>CTGAAAGCCCGAGAGAAGATAAAACCGGAGATGTTCCTGTATAGCAAACACATGAACATTTACCTGGGCATC<br>CTCGACATGGTGGCCAACAAGCTGGAGGTGGACCTGATCACCTTTCTCGAGCACCATAAGAAAAGGGTGGGG<br>GATATGGATGGCGTAACTTACGTGACCGAGATCTACACCTGCAGCGTCCGACATTGGCTTCAATACAAAA<br>CTTGACATGCTGGTGAACAACTACAAACGGCATCTGTATGTGGAGATGAAGGACAAAATCAACAGTGATATG<br>AGTCTTGAGGAGATCGAGAGCGAGGTTGAAGGGGTGAAGGTAAAGGTGCACAAATGCAACATCAAGAAAGAA<br>CTGGATATAGACAAGCAATATGACGATTACATCAACTGGCTTTACGACGAAAACAGAGACAAGGGGATGAAA<br>AGCGGCCTGACCTATCTGGACAAGTATCTCGGCAACTTCCAGAAGGGCAGGCTCGTCACCGTGTTCGCCAGG<br>AGCGGCGTCGGCAAGACCACGTTCAGCTTGCAGCTGGCCGCCAATATGGCTCTGAAGGGCCACAAGATATTC<br>TACGGGAGCGCAGAGATGACCCGCAACCAGGTCTTTAACAGGATCGTGGCCTCAGGTTTGAGCCTTAGCGCG<br>AAGGCGATTGATGAGGACACCATCCTGAAGGAGGACAAGGAGAGCATCGCCAAGTTTATGACCAAGGTTATC<br>AACAACAAGTTCTACGTGTCAACCGAGACCGACTTCGAAAAGTTCATCGACGAGATAAAGGTTTATAAGCTG<br>CAGAACAGTCTGGACGTGGTGTTCGTGGACTACATTAACAAGTACATCGACTTCACCGACAGGGACATGTTG<br>ACCAACAAACTGGGGAAGATCAGCGGCATGCTCAAGAGCCTGGCCATGAAGAGGATATCTGCGTGGTGCTG<br>ATGGCCCAGGCCAATAGAGTGATTGACAAGAAGGTGGGTGACAATGCCGTCGAAAAAATCGACAGCAGCGAC<br>ATCCAGGACAGCGCCAGAATCGAGCAAGACAGCGACCAAGTGATCGGCCTGTACCGGAACGTGAAGCTCGAT<br>GATAAAATGTATAGGGAGAACCTGTTCAATCAGGGCAAGCTCAAGTATAATTCCAAGAACGCCGACGACAAT<br>CCGGAATGCATGAACGCTGTGATCATTAAGAACAGGCATGGCGACCGAGGCACGTGCACTGAGGTGGCAC<br>GGCAGGTACAGCAGGGTCAGCGACTTC |
| 224 | 66 | CTTCACCTTAACTACCTCCCATTGCGCTTTACCGCCGATATATTCAAGGGTGGTGCTTTGACATTTCCCGAA<br>GGCAGCGAGAAAACTGGACCAGCGACGATCCAATCAGCAAGGAGCTGAGCAAGTTGCGAGAGAAACACGGA<br>GATAGTCATGTCTTCCACCGGATGGGAAACAAATTGCATGTATCCCCGTTGTGGAGAACGCCATTGCTATA<br>GGCACCGAGACGGATTTCAACATCATTAGTGACTTTCAGCTGGCTAATGCTCTTGCTCGCAGCGCCCTCCAC<br>AGGTACTTCAAAGCTGCGGGAAGGGAGACTGTAATTGGGTTCCGACCCGTAACCCTTCTCTTGGAAAAACAC<br>AACTTGGCCAGCAACAGGAAGGACGTGTTCGGCATTTTCCCCGAGTACACTCTGGACGTCAGGCCTCTTGCA<br>CCACATGAGGGCGACATAGCGAGCGGAGTGCTTATCGGCTTTGGAATAAAGTATGTTTTCCTTCAGAACGTA<br>GCCGAGCTGCAGGCACAAGGGGTGAGTGCCGCAGGGATGTACGCCGTGAGGCTGGTAGACGAGAGCGAACAT<br>CAATTTGACCGGGCCTACCTGGGAAGGATTGATCGGTTCACAAAAGATAACGTGACGCTCGTTGACAGCGAT<br>TACGCGGAATATCCCGCCGACCAGTGTTACTTCGAGGGAAGCAGGACCAACATCGAAGCCGTGGGCCGAAGT<br>CTCCTGGGGAAAGACTATGATGCCTTCAGCTCAAGCTTTTGCAGGAGAGCTACAAAGTGACCGGAGCCCCC<br>AACCCAAACCCCAACGACTGCACCAGTTGGGCGCGTGGCTCGAGGCCAAGAGTCCGATCCCCTGCGCCGTTGGT<br>CTGGGAGTACGGATTGCAAAAAAGCCGCATGAGTGCTCACGAGGCAACGACGCCGGGTACAGCCGCTTTTTC<br>GACAGCCCCAAGTGCGTGCTGCGGCCTGGCGGCTCTCTGACCGTGCCCTGGCCGGTCGACAAGCAGATAGAT |

TABLE 18-continued

Argonaute and helicase DNA sequences

| SEQ ID NO | Argonaute # | Sequence |
|---|---|---|
| | | CTCAATGGCCCTTACGACGCTGAGAGCTTTCCCAACAAGAGGGTACGAATTGCCGTCATCTGCCCTCAGGAA<br>TTCACCGGGGATGCGGAAGAGTTCCTCCGGAAGTTGAAGGAGGGCCTTCCTAACGCACCGGACGGCAGTCCG<br>TTTCGCAAGGGCTTTGTTCGAAAGTACCATTTGTCTAGCTGTGACTTCACGTTCCATGAGGTTAAGCGGAGC<br>TCAAACAGTGACGACATCTACAAGGATGCGTCCCTTGAGGCACTGAAGCAGAAGCCAGATATGGCAATCGCC<br>ATAATCCGGTCCCAATATCGCGGGCTGCCCGATGCTTCTAATCCCTATTACACGACAAAAGCTAGGCTGATG<br>GCCCAGGGCGTACCAGTTCAACTGCTGAACATAGAGACCATCAGGAGGAAGTCTTTGGACTACATTCTGAAT<br>AACATCGGTCTTGCGATGTATGCCAAACTTGGAGGAATCCCTTGGACCCTCACCCAGAATAGCGACATGGCG<br>CACGAGATCATCGTCGGGATAGGGTCAGCCCGGCTCAATGAGAGCAGGAGGGGTGCTGGCGTAGAGGGTCATC<br>GGGATCACGACCGTGTTCAGTGGTGACGGACAGTACCTCCTCGCCAACAACACCCAGGAAGTTCCCAGCGAA<br>GAGTACGTAGACGCATTGACTCAGTCTCTTAGCGAGACAGTATCAGAGCTTAGGAGCCGGTTCGGTTGGCGC<br>CCTAAAGATCGAGTGAGGTTCATATTCCACCAGAAGTTTAAGAAGTACAAAGACGCAGAGGCGGAGGCGGTT<br>GATAGGTTTGCACGCTCACTGAAAGATTTTGACGTGCAATACGCCTTCGTGCATGTGTCTGATTCTCATAAC<br>TGGATGCTGCTGGACCCAGCTAGTCGGGGGTGAAATTCGGCGATACGATGAAGGGCGTCGCCGTCCCTCAG<br>CGGGGACAATGTGTGCCCCTGGGGCCAAACGCTGCGCTGCTTACTTTGAGCGGTCCGTTCCAGGTAAAGACC<br>CCACTGCAAGGCTGTCCGCACCCCGTGCTGGTGTCAATTCATGAGAAGAGCACTTTTAAGTCTGTTGATTAC<br>ATAGCCCGCCAAATCTTCAATCTCAGCTTCATCAGTTGGAGGGCTTTAACCCTAGCACCCTCCCAGTGTCC<br>ATTTCCTACTCCGACATGATCGTAGACCTCTTGGGACATCTTAGACGCGTTAAGAATTGGAATCCGGAAACC<br>CGTGTCTACCGCTCTTAAGGAACGAAGGTGGTTTCTG |
| 225 | 15 | ATGCAACTGAACTATTTCCCCATCCAGTTTGACTTTTCTGACTACCAGGTCATCACGCAGCCCTACTCCGAC<br>GAGAGATTGAAAGAACTCAGGCAGGCCTACAACGCCAGCTATTCCTTCTTTCGGGACGGCAACCTTATCGTA<br>ATTTCCAATAAAGAGGACGAGGAAAACCAATTGACGGGCAACGTCGAAAACCGCAGCTGTTCGACGATGCC<br>AAAGTTACCGCCAGCATGGTCAAGCATATATTCTTTAGGACGTTCAAGGACAGGTTCCAAGGCTTCATCCCC<br>GTGGACTTTTACCCCTTCCGATTCTACAGCAGACAAGAGAAGGACGACCTTATTCTGAACCACCTGCCCGAA<br>AAACTTAAGCATAAAATCGCCTTTAAGAAACTGATCGAGGTGCAGCTCAGGGAGACGAATCTTAATTCAACC<br>CAGGGCTTTGCTTTCGTCGTCAACATCAGGAGAAATTGGGTGTTTAACATTTCCTGTCTCGAGCTTTATCAG<br>GAAGGCTTTGACCTCACAGATTTTGAAGTGCTCCATGCGGAGACGCTTCCCGGGTTGGACAATATCCTGGCC<br>CCGAACGAGGACTTCGTTGGCCTTCTCAAGAGCATCAACGGCGAGACTGCCATTGTGAGCACTAGCGAGGGT<br>GCCCGCTCCTATTCACTGCAGGAGCTCTTCATTCGCAAGACTAAGCACAACATACAGGCGTACCTCAACTTC<br>GCCACCGGGGAAAAAAGTGCGACCAGATCCTTGCAGCCGTGTCCCAGGAACGAATCCGGAAGCAGAACCCC<br>GTGAATCAATTCAGCGAGATATCCAACATCGCGAAGCATCTTTTTTCAGACAAAGGCAATCCAGTGCTGTTC<br>CAGAATATGGATGGCTTTTGTTTTAAAGTTGACACCACGCCGATGCAGGTACAAAACTCCATGAACCTGCAA<br>ACTCCACGTTCATCTACGACCACGCGGGTACCAAGACGAACACCCGCAACGCGGACCAGGGGCTGAGCTAC<br>TACGGCCCCTACGATAGCCTCACCTTCGACATTAAGAAGCCAAGAGTTCTCTCTATCTGCCATAAGACCAAC<br>CGAGGCTCCTTTACGCGCTTCCTCCACGACCTCAAAGACGGGCTCCCCAATAGCAGCTGGTTCAAGAAGGGC<br>CTCCCTGAAGAAGTACGAGCTTCAAGAGGTGAATTACCTCATCCAGGAGATCAGCGACTACAGGTTGGAGGAC<br>TACCTGGAAGTGATCTCAAACTACGATGATGAGAAGCCGCACCTGGCAATCATCGAAATTCAGATAGGTTC<br>AAAAAAACTGTCCGACCGGGACAACCCCTATTTCAAGATTAAGGCAAAGCTGCTGAGCCTTGAGATTCCCGTA<br>CAATTTGTGCGCAGCACGACTTTGAGCAGCTACAGCGAATACATACTTAATCCGCTTGCATTGCAAATCTAT<br>GCGAAACTCGGCGGCACGCCTTGGGTTCTTCCGGCCCAACGCTCCGTTGACCGCGAAATCGTTATTGGCATA<br>GGTCACTCACTGCTTCGGAGTGGCATGTATAAGGGTGCTGAAAACAGCAGGGTGGTCGGCATTACTACGTTT<br>ATGTCTAGCGATGGCCAATACCTCCTGGGCGACAAGGTGAAAGACGTGCCTTACGAGTCTTACTTCGAGGAG<br>TTGCTGAAGAGTCTCAAAAGTAGCATAAGCAGACTCTCCGATGAGTATGCCTGGCAGGATGGCGACACAGTG<br>CGCCTCATTTTCCACATCTTCAAACCCATCAAGAACGTTGAGTTCGATGTCATTAGCCAGCTTGTGAAGGAC<br>ATCGACCAGTTCAACATAAAGTTCGCGTTTGTGACCATTAGCAAGTCACACCCGTCTATTCTCTTTGACACG<br>AGTCAGCAAGGCGAGAAAAAGTACGGCTCTAACCAGGTGATAGGGCAGTACATCCCTCAGAGGGGTAGCAAT<br>ATCTTCATAGATGACGAAACCAGCCTGGTGCAGATGCTGGGCGCCAGGGAACTTAAAACTGCCAAACACGGG<br>ATGAGCACCCCAATCCAAATCAAACTTAGGACACCGCAGGGTAACCATAACGACCAAGAACTGAAGGATTTG<br>ATGTTTTACGATCTTAACTACACATTACCCAGCAGATCTATAGTTTTACTTACTTGAGCTGGAAGAGCTTTTTG<br>CCACGCGAGGAACCGGCCACAATGCTCTACTCCAACTTGATATCCCGACTTCTTGGGAGATGAGGAGCATC<br>CCTGAATGGGATGCGGATAAGCTCAATTATACCCTTAAAAGGAAGAAATGGTTCCTG |
| 226 | 22 | ATGTTGGAGACGAATATCAGGGTGGTGCGGCCTGGTCCGCAGCTGTGCGTTCCTGTACGCAGGGTGATCGTG<br>TCCGGTCAAACCTTGGCTCCCGACCTCCTGGAGAGGCTGTGTAACCTGCTGCGAAGGAGGTACGGCATTAGC<br>GCCGCAAGAATACCGGGCTCCGTGAGCGAGCTGTTCGTTGCGACCGACCGGCAGGTGGAGAAGGTGACACTG<br>GAAGAAGATAACTGGCAACTGACCGCCGTGGACTCCAACGACCCTACTCGAATCATGTCCATCTCTAACACG<br>GACGATGAGAGCTTTATAAGCATCCTGATCGAACGCGCGCTCCTTGCCCAGATCGCCAGTCGAAGCCTCTTT<br>TGGACCCTCGACTCTCCTCGAATTTGGTATGAGAAGAACCCGTTCCAAAGGAATGAAGGCGTAGCCGTCTAC<br>CACAGGTACGAGGTGGATGCGCTCCCCCTCGGCGACGCAGGCATTGGCATCTCAGTGGTGTTCAACGGCC<br>TTTTTTAGCGAGCACACCCTGGAGTACTACTTCGCCCCCAACCTGATTAGCGGCGAGAGCAAGACGCGACAG<br>GACGAATTCCACAAGTTCACCGGCCGACAAGCTGGTCAAAAGGGGACGTGCTTTACAATAACGGCAGGAGT<br>AAGGTGAAGTGCTATTTCGAGAACAATAGGGTGGGCCTGACATGTGGCGCAACCGGCCAAATGAAACTCGAG<br>GGAATCACGTATCCCAGCCTGTACCACTACTATGCGAGCAAGTATAGCGCATTGCAGATCAACGAGAACGAT<br>GCCGCAGTGCAAGTGTCTTTCCCTGGCTTGGACCGCCCAGTTCCGGTAGCCGCCAGGCTCCTGTCCCTCCGA<br>GTGATGAACGACGACGTGCCCGATGGTCTGAGCTCCGTCGACAAGATCCCTCCAAGGAACCGCAAGTACCTT<br>ATCGGACAGTTTTGGAAGTGCCTGGAGCCGAGACCTTTCGGGAATGTGGCCCCTGGTGTCTTCGACGGCTTC<br>TGGAGACCCAACAACGAAAGGGTGCATTACATCCAGCTGCCCGAGATTAACTTTGGACAAGGCCAAAAAGCA<br>GAACCGCCTGACGTACGCTCCGTTGCATCCATCAAAAACTATTTTAGGCGACGACTGGAATTGCTGGGTCAC<br>GCGGGGGTGTTACCACTTTCCGCCCTCAGCCCCAGGACAATCTTCTGCGCCTACCCGCAGTCATTGGGTGAG<br>GAGATCCCGGAAAAGTTGGTGAACGGGATCGTCAATGTGCTGAACAAGTGGACCGGCCGCTCAGCTTCTGTAGC<br>AACCTGGTAAGCTACAGCACGGCCAGCGAGGCGTACGGTAAATTGAGGAGGGCCGAGAGTGCCGGCGTGGTC<br>CTGTTCATCTTGGACGAGGAGCCGGCAGTCTACTACGACGCGAGCTTCAATCTTGAGGGCTGGAGGGTAAAG<br>CGCGTAACCGAGCCTGTGCTGCGCCAGCAGCATAAGTATCTGACCAACGGCGTGTGGGACCGGAAGAGGCAA<br>GAGTATAGTTTGGGGAGGGGCAGAGTCGCTGGGAAAGCTTCATCAATTTGATCGGATTGGACGTTATCCAG<br>CAACTCGATGCCATTCCGTATAGGATCCCCAACATCGGCCCCTACGAAGGCCAGCTGATAATCGACGTGGGG |

TABLE 18-continued

Argonaute and helicase DNA sequences

| SEQ ID NO | Argonaute # | Sequence |
|---|---|---|
| | | CATGACAGGCAATTCTTCGCCGTGTCACTGCTTATTGTGAGATCAGAAGACAAAGTGCCCGCATTTAACATC<br>AGCAGCCAGGTCCAGCACAAGGCGGATCATAAGCACGAAAGCATTAACCCGGTGCTGTTGAAGGACACCATC<br>ATTAACGTGTTCAAGACCGCCAAACGGAGGACTTTTGATCCTCTGACTAGCCTGTTGATCATGCGGGATGGC<br>AACGTGCAGGGCAGCGAGATCGGCGGGATAGACAACGCCCTGGTCGAACTTAGGCAACTTGGCATAATCTCC<br>CCCGATGCGAGGCTGGACATCGTGGGCGTACACAAGGAATCTGTAAGCTCCATCAGGCTCTGGGACGTTGAC<br>GTAAGGGGGGAGGTAAGCAACCCGATCGAGGGCACCGGTCTGTCAGTCAACTCATCTCTGTACCTGGTGGCG<br>TGCACAGGTGAGGCCACGCTGACCCAAGGCACCGCAGAGCCCGTGGCCATCGTCGCAAACAACAGGTGCCTG<br>AGTATTGCCGATGCAGCCCTGAGCGCCTTTCTGGCAGCCCAACTGAACTGGAGCAGCCCGGGAGTCGCCCAG<br>CGCCTGCCCCTGCCCTCTGAAAAGAACAGATGAGGAACTTACCGCTAGGAGCGATCAAGAAATTAGGAGGATA<br>AGG |
| 227 | 32 | GTGCAGCAGACAGTGGAGCTCACCCTCTACACAGAAAAACATCCCGACACCCACCCAGAGCTCGTTTATGCC<br>GACGAGTGTCCCGACCTGTGGCAACAGCACAGCGAGCTTACGGGGGACAAATCTCTGTTCTACTCTCTTACG<br>AACCCCGGCAGAATGCAAGGGAACCCAGTACACAGTGCAAATCAACCTGAATAACCAGAAGCAGCGAAGGATC<br>GCCAAGCACATAATTAGCCAGCAACTGTATAATCACTTCCGCCAGACCCAAATCGCTACCTTCGACAAGATC<br>GACAATGTGGAGGTGTGGACCAAGAACACCCAACAGCTACCCAGAATTGCACGGAGTACCTGAGGTTCAGC<br>CTTATACCCCAATACGCCGTGTTCTCTGACTCATGGGAGCTGGTCGTGTCCTCAAATGGCATATCCACCGTG<br>TATAACAAGCCTTTGAGCGCACTGGACCTTCAGACCGACCGATTCAAGGTCGTCGTTGGAGGGGAAGTGGTC<br>AAGTACAAGAACCTGAGCCCCAATCAAAAGCAACAAATAGACGAGGCCTTCCCCAAAATCAATAGGGAACTG<br>GCCGCTGAACTGCATATTAACGAGAAACGCTTTCTCAATAAAGACAAGTATACGACCACCTACAACCACATT<br>AACAACTTCGTGCGACAGCACCTTCTCACATCCGAGTTCCAGGCACTGTTTTGTCTGAGCGGCGAGATGTTC<br>AACGTACCCGAGGAGCGGATCGGCCAAGTGGCGAAGGGGGCGAACCTGTTGCAGTTTAAGGACGGCAAGACC<br>GGCATTGACCCATTCAGCTGTGTGTTCGGCAGCAAGAGCATGGACGCACTCGGCATCTACCAACCCAGCCTG<br>AAGCCCCAGGTGAAATTCTTTTTCATCGCCCAGCAAGCGATATCAACGTGTGCAAAAGCCTGTACGATATT<br>TTCACGAAGGGATACAAGCCCTACGTGGACACAGCCACTGGCGAGCAGAGGTACGTGTTCCCACCCCTGGCG<br>ACGTGCATCAAGCAGCCCTTTTCAACCGACCCCAAGGGGAGCATTTACTTCAGCGACCCTCAAAATGCCCTG<br>AGCGAGATCAAGAGCCAGCTTAACAATAAGCCTCTTGACCCCCAAACGCAGTATGTGAGCATATACGTGTCA<br>CCCATCCCTCGCGACGCCGTCAACAATCCCTACTACGGTCTGTACTTTCAGATTAAGGAGCTGCTGCTCGAA<br>AAGAGGATAACGTCTCAGGTGATCTATAAGGACCGCCCCAACAACCAGTACTTCAACTTCCATCTGCCCAAT<br>ATCGCGACTGCCATCCTGGCAAAAATAGGCGGCATCCCGTGGCAGTTGAACTCCCACACGACGAACAAAGAT<br>CTGGTGATAGGCGTGGGCGCCTTCCTTAGCGAAAAAGTTGGCGAGAGGTATGTGGGCAGCGCGTTCAGCTTT<br>AACCCCCAACGGCCTGTTTAAGAACTTCGACTGCTGTAAAGCGAACGATCTCGAATCTATCGTAGCCGGGATC<br>AGAAAGGCCATCGGACACTTCGTTGTGGACAGCAGAAACAAACCCCCAGAGGCTGATCATCCACTACTACAAG<br>ACCATGTCAAAGAGGGAGGCCAGGCCCATCACGCAGATGCTGAACACGCTTGGCCTCAACATTCCTGTATTG<br>ATCGTCACAATAAACAAGACGGAGACCAGCGACATTGTTATGTTTGATGAGAAACAGCAGGGCTACATGCCC<br>CTTTCAGGCACCGTACTGAAGATAAGGAACGATGATTTCCTGCTCTACAACAATAGCAGGTACAAAGAGAAC<br>GAAAAGTCAGATATGCTTTTTCCAGTGAGGATCCGCCTGAGTAAGATCGTAAACCAATCCGACAAAGACATC<br>CCAATGACAGACGCCTTCAATTTGCTCAACCAAGTGTACCAGTTCTCACGCATGTATTGGAAGAGCGTTAAG<br>CAGCAAAACCTGCCGATCACGATAAAGTATCCAGAGATGGTGGCCGAGATAGTGCCACACTTTTCAGAAGCC<br>GAATTGCCGCAGTTCGGAAAGAATAATCTGTGGTTTCTG |
| 228 | 91 | GACCTGTTCCTGGGCGCTGGCGCCTCCATATCTAGCGGTATCCCTTCCGGAGGCGACCTCGTCTGGCATTTT<br>AAGCGCGAAATACTGAATTCCAACGGGAAGATAAATATTAAAAATTTCAAGATCTTAAGATAGAAGATAAT<br>AAGAAGGTTATACAAAGTTTCTTTGAGGAGACTGAGGAGAACAACATTATTAATCCTTATTCCTATTATTTT<br>AACAAATGTTATCCAGACCCCTTGATAAGAAAAGAATTCTTGACGAATCTTGTGAGGGACAAGAAGCCTTCC<br>ATAGGATTTATGTGCCTGTCTGCTCTCGTGAGCAGCAAAAAATCAACACAGTATGGACAACTAACTTCGAT<br>GACTTGATTGAGAAGGCGATTAACGGATTGAATTACAAGTCCTGTCAAATTGTCTCACCCGAGAATGCGGGC<br>AGCGTGAATAACTTTCGAACTGATATCCCCACTGTTGTTAAGCTTCACGGAGATTTAGGTATGACCCACTG<br>CAGAATACTGACGAAGAGTTGCAGAAACTCGAAGAGTCCTTGCATAAGTATTTCGTAGAGGCAAGCACAAAG<br>AGGGGACTTCTCGTAATGGGCTATTCTGGGTCAGATGAGTCTGTGCTGCAAAGCCTTGAGAAGGCGCTGGAA<br>GAGAACAACGCGTTCCCTAAGGGACTCATTTGGTGCATCCCCAAAAGTGTCACCCCAAACCAACGACTGGTC<br>CGAATTATATCTAAGGCTAATGAGCAGAACCAGCGGTCCGGATTTATGATTATCGACAGTTTCGATTATTTC<br>TTGCATGAACTCTACAAAATATGCGACCTTACGAATGACTATATCGATCTCTATTACCAAGGAGAGATTTGAA<br>AAAAGGCAGTCATTTAGGCTTAACCAAACTCCGTCCTCTACTCTGCCAATCTTGCTGAACGCAATAAAAGCA<br>AAGCACTTCCCGAAAAGTACCTTTCTGACTAAAACGAATATCTCAGGCATAGGTAAGTGGAAACGCTTGCGA<br>GACGCTATAGGAAATAGCTCTATAGTCGGATCTTTCGGTAAGAACGATTCTCTCAGACTTTTTGGAAGTGAA<br>CAAGACATTAATAATGTACTTAAGAACTACTTGTTGATTGATGATTTGAAGATCAGTGATATCCCAGAGCACCTT<br>TTTTTCCATTCTGATTCATTCTACATTGGCATGCTTTATGAACTGATTGAAAAGTGTTTGATTAAAGATTAT<br>GGGCTGTCAGTATATGCAAAGGGGAGAACTATCAGAAAGTTCTATTCAATCAATAACCCGCTGCCGGAATCT<br>GAAATCGCAGATATTAAGAAGAGAAACAATAATTTTAACATCGACAAAAATATAAATGTATTTGAGGCGTTC<br>GAGTTCTCCATAGAATTCATTAATAAGGAGCTGTTCCTGTTGCTGTGTCCCACCATACATATTCAGACTAAA<br>CTCGGAGGTGAGGTCAATCGCAATATCTCTCAGTACCTGTCAACAACAATCATCAGCAATAGGTATAATAAC<br>AAATATGGGAAAAGCTGAATTGGTGGATTAACGAGCTCAAGAAGTATAACAAGGACTTGGTTTTTAAATTG<br>GGGGACTTTGAGATACGATTGACAGATTATTACTCCACGAGCGCTAAGCGCGTTAAAGATGACATCTACTGT<br>TTTGACGGATTTACTAAGTTGAGTGAGCCCAGTATATATTTCCACTATCAAGACGAAGCAAAGCAGAGTATC<br>CATCCCATAAGTGGACTGAAGATACTCGGTCCATTGGAAGAATCATTCGAGGCAAACGGTACATCTTCCACA<br>GTCAACCTTGCCATCATTACTCCGGACTTTGGCTTCTCCAAACTCAAGGCGCACCTCGAAAGTTTGCTTAAT<br>ACAATTTCCCCTATATGGGAGAAGGAATACTTGAAGGAGTTCCCTGGTTTCGATAACGTTTTAAGAAGCAC<br>CTGATAATACCCAATTCTATTCAAAGCGAGTATGTAATCAGCATACCTAATAATGATGTAAAACAGTTCTCA<br>GCAATTCAATTCTACGACTACCTGAAGAGTAAGATCGACCGACTCGCTCTGAAGTCCAATGACATTGATTGT<br>CTTGTAATATACATACCCGACCAGTGGAAGAACTTCCGAGAGCTGAAAAATGAAAACACATATTATGACCTT<br>CACGACAGTCTTAAACTCTACTGCGTAAAAAAGGGGTTGCAATCCAGTTCATCGAAGATAAAAGCATTAAT<br>TATAAAGACCAAGCCAAGATCCGGTGGTGGCTGTCTCTGGGGCTCTACGTGAAGTCTAACGGCACTCCCTGG<br>AAGATCAAAACAGATAATACAGAGACTGCCTTTGTGGGCCTCGGTTACGCTATACGACAAAATGTTAAGAAT<br>AAGGTTGTTCTCGGGTCTTCACAGATTTTCGACGGTTATGGGAATGGTCTCAAGTTTCTTTTGCAGCCCATA |

TABLE 18-continued

Argonaute and helicase DNA sequences

| SEQ ID NO | Argonaute # | Sequence |
|---|---|---|
| | | GAGAAGCCAATTTTTTACAATAAAAACCCCTTCATGAGCAAAGAGGACTCTTTTCGGCTTATCAGTAATATA<br>CGAAACACATATCATAAGATCGATCCAGTTATCGGACTTAAGAAACTCGTGTTGCATAAGACAACTCATTTT<br>ACTTCAGAGGAGATGGAGGGGATCTCTAATGCTTTGGAAGGCATAGACAATATTGAACTCTTGCAGATTCAG<br>CAATTCTCATCATGGAGGGCAATTAAGCTTATGAAAAATGCCACAAAGCACGATTTTAATGGTTATCCGATC<br>GATCGCGGAACTATAATTCAACTCGACGACTTCTCTTTCCTTCGTGGACACACGGGCTTATAGAGAACCAA<br>GAGCTGAACGGTAAGTACTACCAGGGAAAAAGAGGAATACCGGCTCCGCTTCTTATTAAGAGATTTAGAGGC<br>ACGGATCCAATAGAGACGGTGGCAAACGATATTCTTAAGCTGACCAAGATGAATTGGAATGGTGCAGAGCTC<br>TATAAAACCTTTCCTGTAACTGATTTCAGTAAAAAACTTTCAGTCATGGGGAAG |
| 229 | 0 | ATGCCTTCAGCTCAACGGTGCATCTGGGAGTGGAAGAGGGATATCTTCGTGACCAAGAATCCGACGCTCCGG<br>GAGTCCGTGGATGAACTTAGCTTGCCAGGGACCAGGCGCATCGTACAGGGATGGATCGACCAGCAAGCCCAA<br>TACCCGGAAGATGGGTCAGCAGACGAATATAGCTTTTATGCCGAAGAGTGCTACCCAACCTCTCATGACCGG<br>CGAGCGTTCTTCCATCGCTTCATTGCCGAGGCGAGACCGCATATCGGCTACAAGCTGGTTGCGCAGTTGGCA<br>GAAGCAGGGTTCTTGAGAACCATTTGGACGACCAACTTTGACGGACTGGTTAGCAGAGCGTGCACAGCGGCT<br>AACGTCGTGTGCGTGGAAGTGGGCATGGACACACCCCACAGGGCCTCACGACCGCAAGGGGATGACGAAGTC<br>AGACTGGTGTCCCTCCACGGTGACTTTAGGTATGAGCTGCTGAAGAACACCGCCAATGAGCTGCGCGAGCAG<br>GATTTGGCCCTTAGGGAGGAACTGCTGCACGAACTCAAAGACTACGACCTGGTGGTCATCGGATATTCAGGG<br>CGGGACGACAGCCTTATGCAAGTGCTCTCTGCTGCCTACAGCGACCGCGCATCTTGTAGGCTCTACTGGTGC<br>GGGTTTGGCGCGGAACCAGCACCGGAAGTGAGGCACCTTATTAAGAGCATCGACCCAGCCCGAGAGAGCGCG<br>TTCTACGTGGATACCGCCGGATTTGACGACGTAATGAGCAGGCTTGCACTCAGGCGACTGAGCGGTGAAAGC<br>CTCGAAAGGGCCCAGAAGCTCATAGAAAGCGTCACCCCGGTTGCTGGCAAAAAGATGGCCTTTAGTGTTCCA<br>CCATTGGCCCCTAGCGCCTTGGTGAAGGGTAATGCCTACCGATTGACCTGTCCGGCAAACGTCTTGAAACTT<br>GATATCGAACTTCCCGAGCACGGTTCCTGGCGCGATTGGCTGTCCGAACGAATGACTCCAGAAAGGGGGCAG<br>GCCGTTGTGTTCGAGAAGGGGAGCACTGGTTTTGGCCGACATGGCGGTTACCGCTAAAGTTTTCGATGGATTT<br>CTTAGGGTGAGCCCGACACGGGTGGAGATAAGTGACGAGAACATCATCGCTGACGGCCGGATCGCCAGTCTT<br>TACCGACGAGCTCTCGTGAGCAGTGCCGCAAAAGCGCTCCAGATCCAAACCGACCACAGGAGGAGGATATGG<br>GAGCCCGTGCACTATGATACAAGGCAACTCGACGATGTGACGTACCGCGTGCATCGAGCCGTCTCCCTGACG<br>ATAGTAGGGATAGAGGGAGTGCCCCATGTGGTGCTGATGCCAGAGGTCGTCGCATCTACGTTGGCGGGCGAC<br>CTTGCGCCGGTTGACAGTCAAAAGACTCTCCGCAATGCCATTTACGGGTTCCAACATAACGATAAGTTTGAT<br>GCCGACCTCAGCTATTGGACCCACCGCCTTGTTGAGAAGGAGCTGGCTTCCAGCGGCGAGGGCGTTTTCGTA<br>TTGAGCAAAGTGCCACTTTATGCGGGCCTGGCACAAAAAGGTAAAGCTCCTCTCCCACACAGGTTTGCACGC<br>CACGCTAAACAGCATGGAATTATTGTGCCCGACGCACCGCTTGTTTTCAGCGCCAAGGTTGGCTCTGGAGAG<br>GTACGAAACCCCAATCCGCTGCATGGGCTGGTGCAAAACCGGCCATGGGACCCACTCTCTTACGGCGTCTGGT<br>TTGTGTCCGAGTACAGATGCTAGCGTGATCTGCCCCGCAGACGCTGCTCCGAGGTTTGAGAGATTCCTCCAA<br>TCTATGCAGGAGGTAGCAAGACCAAGCCAGAGCGAGAGGGACTATTTGCATGATTTTCCCGGCTTCCCTGCG<br>GCCTTTGGACTGCCACTCCGAATGCCCGTGAGAGGGGACGCAAACTGGATTACCATCGACGACGGAGTGAGC<br>ACCGATGCCCTGACAGGGCTAAGCAACTGGCGCACCGAGTGTGCCAAGCACTCGACCACCTCCGCAGAGCA<br>AGGCCCTCTGACACGGCGATCGTGTTCGTTCCCAGGAGATGGGAACCATATAAGGTAGTGGACACGCAGCAC<br>GAAAGATTCAATTTCCACGATTACATTAAGGCCTACGCGGCCAGGCACAGTCAGAGCACGCAGTTCGTCAGA<br>GAAGAGACCATCCAAAGCCAATACGTGTGTAGGGTCCGGTGGTGGTTGAGTTTGGCACTGTATGTTAAGGCT<br>ATGCGGACCCCCTGGCGGCTGGATGCGCTTGATGAGAATCGGCCTTTTGTTGGTATAGGGTACTCCCTGGAC<br>GCAGAGGCAGGGAGGGGCAACCATGTACTGCTCGGCTGCAGCCACCTGTATTCTGCGAGGGGTGAGGGATTG<br>CAGTTTAGGCTGGGCCGAATCGAGAATCCCGTGGTGCGAGGAAGGAACCCCTTCATGAGCGAGGACGACGCA<br>AGGAGGACCGGAGACACCATCCGGCAGCTTTTCTACGATAGCAAAATGCATATTCCGACAAGGGTGGTGATA<br>CACAGAGGACAAGGTTCACTGACGAGGAGCAGAGGGGGTTGGTACAAGGATTGGACGGTGTGAGGAATATC<br>GAGCTGATAGAGATCAACCAGGAAGAGAGCTTGCGATATCTCAGCAGCCAGATGAAGGACGGCAGATTTGAG<br>ATCGACAAGTTCCCCCTGTTCAGGGGTACCACAATAGTTGAGTCAGATGACACTGCATTGCTGTGGGTGCAT<br>GGAGCCACACCCAGCGCCGTGAACAAGTACTGGAGGTACTACCAGGGGAAGCGCCGCATTCCGGCGCCATTG<br>AGGATTCGAAGGTTCCTCGGGCAAAGCGACGTAGTGCAGATCGCGACCGAGATCTTGGGACTGTCTAAAATG<br>AACTGGAATACGCTTGACTACTATTCAAGGATGCCTGCGACTCTGGATTCTGCAGGCAGTATTGCCAAGTTC<br>GGGTCATATCTTGATGGGTTTACGAGCGCACCCTATGATTACAGACTTCTGATC |
| 230 | 6 | GTTCACGCATTGCTCGCTCTGCTCGCGAACCGAGCCGGTGGAAGGACCGCCAGAATGGGAGACAGCTTGCTC<br>ACGTGGAGCCCTCCTGAGTCTCTGCTGCTTGAAGGGACCCTGAGCTGGCGCGGCAACACCTACACATACCGG<br>CTTCGCCCACTGGCGAGAAGGGTGCTCAACCCTAGGAATCCCAGTGAGAGAGCGCCTTGTCCGCGTTGGCG<br>CGACGACTCCTCCGAGAAGTGCTTGAGCAATTCAGGCGCGAGGGGTTTTGGGTTGAAGGTTGGGCCTTTTAC<br>AGGAAGGAGCACGCACGGGGTCCCGGGTGGCGCGTGCTGAAAGGTGCGGCGCTGGATCTGTGGGTTTCAGCC<br>GAGGGGGCCATGGTATTGGAGGTGGATCCGACTTATCGAATCCTGTGTGACATGACACTCGAGGCGTGGCTT<br>GCACAGGGACATCCACCCCCGAAACGCGTCAAGAACGCGTACAACGACAGGACATGGGAACTCCTGGGTCTG<br>GGTGAGGAGGACCCGCAAGGCATTCTTTTGCCAGGCGGGCTGAACCTCGTCGAGTACCACGCTAGTAAGGGC<br>AGAATCAGAGACGGCGGGTGGGGTCGGGTTGCGTGGGTGGCAAATCCTAAAGACGCCAAAGAGAAGATCCCG<br>CATTTGACGAGCTTGTTGATCCCGTCTTGACCCTGGAAGACCTGCATGAAGAGGGGGGCTCTAACTTGGCC<br>CTCTCCATCCCGTGGAATCAAAGGCAAGAGGAAACCCTTAAAGTGGCCCTGTCCGTGGCTCGCCGACTCGGC<br>GTCGAACACCCCAAGCCCGTCGAGGCCAAAGCCTGGAGGATGAGGATGCCAGAGCTTCGCGCACGACGCAGG<br>GTGGGTAAGCCAGCGGACGCCCTTAGAGTGGGGCTGTACCGGGCTCAAGAGACTACCCTCGCACTGCTTCGG<br>CTCGATGGCGGCAGAGGATGGCCTGACTTTCTGCTTAAAGCATTGGAGAACGCTTTTAGGGCCAGCCAGGCT<br>AGGCTTCATGTTAGGGAAATCCACGCGGATCCTAGCCAGCCCCTTGCATTTAGAAGCCTTGGAAGAAGCG<br>AAAGAAGCAGGTGTGCAGGCTGTCCTCGTACTCACCCCCCCACTGAGTTGGGAGGAGCGACACCGCTTGAAA<br>GCACTGTTCCTCAAAGAAGGACTCCCAAGTCAACTTCTGAACGTCCCCATACAGAGGGAGGAAAGGCATCGG<br>TTGGAAAACGCCCTGCTCGGGCTCCTGGCGAAAGCGGGTCTTCAAGTAGTCGCCCTTGAGGGCGCATACCCT<br>GCTGATTTGACAGTTGGATTTGATGCCGGAGGCCGCAAGTCCTTTAGGTTCGGAGGTGCCGCATGTGCTGTC<br>GGCTCCGACGGAGGTCACTTGCTGTGGAGCTGCCGGAAGCCCAAGCGGGCGAACGGATACCAGGCGAAGTA<br>GTTTGGGACCTGTTGGAGGAGGCGTTGCTGGTGTTTAAGAGAAAAAGAGGGCGGTTGCCCAGCCGGGTGCTT<br>CTGCTGAGGGATGGCAGGCTTCCCAAGGACGAGTTCACCCTGGCACTTGCAAAGCTGAGGCAGCTCGGCATT<br>GGCTTCGACCTCGTGTCCGTAAGGAAGAGTGGAGGCGGAAGGATTTATCCGACCCGGGGAAGATTGCTTGAC |

TABLE 18-continued

Argonaute and helicase DNA sequences

| SEQ ID NO | Argonaute # | Sequence |
|---|---|---|
| | | GGCCTTCTGGTGCCCGTTGAAGAGAGGACTTTTTTGCTCCTGACGGTGCATAGGGAGTTCAGAGGCACCCCA<br>CGGCCCCTCAAATTGGTACACGAAGAAGGTGAGACACCTCTGGAGGCTCTCGCAGAGCAGATCTACCACCTG<br>ACGAGGCTGTATCCTGCATCAGGTTTCGCATTTCCCAGACTGCCCGCACCCCTGCACTTGGCAGATAGGCTC<br>GTGAAAGAGGTGGGCCGATTGGGCGTGAGGCATCTCAAGGAAGTAGACAGGGAAAAGCTGTTCTTTGTA |
| 231 | 50 | GTGAGGCTGGTAAACCAGAAAGAGAAACCGGAAGGCGACTACGTGTATGGCTACACTCTCCCAATAGACCCC<br>AGTAACAGGAACATGAGGCAGCCCTTCTGGATAAGCATGGATAAAAGGAGGGCTATGAAGCTCATTTCGTT<br>GGCCCCTATGAGAACATTGAGTTGACCAAGAGCGTGATCTTCTGGGACCTTCTGAGGAGGACCAGGGAGCAA<br>CTCAGCAGCGATAAGTTCACGGAATCAAGAAAAAAGTTCTTTAAGGAGATCTACTTCCCCCTTAACCTCTAC<br>AATGAGGGCAGCCAAGGGCTCGCCGTGCAACCCTACTACCTGAAGATTGATCAGCAATTTGGACTGCTGGTG<br>GATTTTCAATTCAAACTTGACAAAGATTTCACCTTCAGCCGGAAGATTCAACAGCTCAGTCTGACATTGGAT<br>GGGAAGAACCGGAGGAACCTCAACTACTACGTCGACAGGATAACCAAAACCAACCAATTCATCAAGGCCCTC<br>TGGAACATCATTGGCACCTTCTCCCATAATGAAAACAAGGAAAACTACACGCTGAGGAACGACTTCTACCCC<br>TGCGCCGCAAGCAGGCTGCGGTCTCGAATGTATCTCTTTTCCAATGGCAGTGAATCCAGGAGCCAGTTCAAT<br>GGCTTGAAGGAATACGGCCCACTCCGACCCCTGACAGCCAATCCGACACTGCTGTTTGTGTTCCGGGAACAA<br>GACCGCGCCGCGAGAAAACTGGCGATGGCACTTAAAGGCAGCAAAAAGCAAGATCAATACAGCTTCCCC<br>GGGTTCAACTCCCTGTTTAAAGCGGACCTGTTGATCGACGGAAATCCCATGGTCTTGAAAGACTTTTCTATC<br>GAGAGCAGCAGGGAGGTGTTGGCCAGGGTGACAACATCAACATCCAGCTTGTTGCCCATTTTCATCCTGCCC<br>AACCGCGAGGGCGACGGCTACCTGGAGCACAAAGCCATCTTCGCCGAGAACGGCATACCTACTCAAGCGTGC<br>ACACTCCAAGTCATTCAGGACGACGTGACCCTTAGGTGGAGCGTCCCCAACATCGCCCTGCAAATATTCTGC<br>AAAGCGGGTGGCTGGCCCTGGAAAGTGCAGAGCCCCGTAACCGACAACGCCCTGATTATAGGCATAAGTCAG<br>AGCCACAAGTTGAATTATAGTGACGGTAAGACAACTGTGGACAAGCACTTCGCTTTTAGCGTGCTGACTGAT<br>TCAAGCGGCCTCTTTCAGAAAATTCAGGTGCTGAGCGAGCAGAAGACGGAGGAGACCTACTTCGAACAACTG<br>AAGCTGAATCTCAAAAGCATCCTGAACGCCAATAGCAAGAACTACCAACGCATCGTGATCCACACCTCATTT<br>AAGCTCAAATACAAAGAAATAAGTGCAATCGAGGAAGTTGTTAGCGAATTTGCAAGGAACAGCAACAGCGCC<br>GACTGCAAGTTCGCCGTTGTGAAGGTTAATCACAAGCATAGGTACTTCGGGTTTAATCGGGAAGTGAATAGC<br>TTGGTGCCCTACGAGGGAACCGTGTGTAAGCTGGGCGATAGAGAGTACCTGGTCTGGTTCGAGGGTATCTAT<br>CAGGAGAAGCCGACCGTTACCAAAGCATTTCCGGGTCCCACCCACATCGAATTTCTTAAAATCGGGTCTAAT<br>AACGTGATTAGCGACGACCTTTTGTTGCAAGACCTGATGAACTTGAGCGGAGCGAACTGGAGAGGCTTTAAT<br>GCGAAGAGTGCTCCGGTATCCATCTTTTACTGCCACCTGGTGGCCGACATCGTGCATGATTTCCAAATCAAA<br>GGCCTCCCTATGCCCGCCATAGATCTTATACGACCCTGGTTCATC |
| 232 | 11 | ATGCAAGAACACCTGAAGACGAACATACTGAACTTTAAATGGCCCAACTCTGCTCCGACCATCTACCTGACA<br>TTGGAGGACATTGAGGGGAGCCACCCTATCCACAAAAGCAAATTTTCTAGACAGATAAAAGAAGTGTTCCCC<br>GACGCGGATTTGAGTAACAAGGACCAGATCTTTACGACATTCACGACCGAAATCCCAGACGCCCCAAGCATA<br>AAACTGAACCTTGTGGACGGCCGAGAATTGCGGATCTATAAACAGTTCCTCAAGCACAAGCTGCGGTCATAT<br>TTCAAATCTAAGGACTACATCGTGGTCAAGAATTTCGTGGGCGACGTTCAAGTGTGGATGCCGAGCAAAAAG<br>GGTAACACCGCAGATTACAACCTGTACTATAAGTTTAGCTTTAAGATCCAATTTGCCAAACTGACGGACCTC<br>CCCGAGCTGATCGTAAGCTACGATGGCACCTCCAAGGTGCTCACGACGTCCGTTAAGGACATCGAAGATTCA<br>GAGCTCATCAAGCGATGCGTCTACGGCCAAAAGACGTTTAACTACCAAATGGACTTGGACACCGAAGAGAAG<br>CAAGAGTTTTACAACGCGATTACAGTTTGACCAGGCCTACCCAATTTTCAACCTTTCCCTGGCAAGGGCACTC<br>GACATCCCCATAGAGGAGCCAATAAGGCCGATCAACAAATACCAAAAATACGTAGCCCTGATTAACAATTTC<br>GCAACTAATTACCTTTTCAAGGAGGACTTCAAGGTTATCTTCCCGTTTAAAACAGACACGTTCATCGACGTG<br>CCTATAAATCGGATAAATCACATCGACCCCCAAGTCGGCCTGTTGGAATTCGGAAAAGATCAATATGGCAAC<br>AAGAAAACCCACCTGGTACCTAAAAAGGCAATGACATCTTGAATCCATACCGGCGACCTAATAATCAGAAC<br>ATCAAAATCTTTTTCATCTGTCACACAAGCCACAAAGACTCCGTGCTCAGCTTCTATCAGAATCTGAAGGAA<br>GGAGTAAACACGGAGAAGAACTACTACAAAGGACTTGAAGCCTACGTGAACATTAAGGCAAGTAGTAGCAAG<br>GAGCATTTTATCGAGTTCACGAACGAGAATGACCCCATCCCGGAGATCGTGGAGAAGCTTGAGAGCCTCACA<br>TTTGATCATGACAATGTTCTCTACGCGGCGTTCTATCTCTCCCCCTTCGACAAATTCACCCAGAATCCGGAG<br>GACCGGGAAATTTACATCCAAATAAAGGAGTTGTTCCTGAACGAAGGTATCGTGACCCAAGTTGTCGATTAC<br>GAGAAAATGGTCGTCAATATCGAGAATCAGTATAACTTCCAGTTCAGCCTGCAAAACATGGCCCTCGCCATT<br>CATGCTAAGCTGGGCGGTGCCCCGTGGAAGCTGGCCGTGACCGACAAGAAGGAATTGGTCATCGGGGTTGGA<br>GCGTTTACAAATCAAGGCGAGAACAGACGCTATATTGCTTCCGCCTTCTCCTTTCAGAATAACGGCTCTTC<br>CGCAAGTTCGAGTACTTCGATCAAAGCGAGACCGACCTCCTGGCTGGCAGTATCTGCAAAGCCATCCGCGAC<br>TTCACCAGCGTAGCGGAGGCAGATAAGGTCGTTATCCATTTCTATAAGGAGATGAGTTACGAGGAGCTTAAA<br>CCCATCATTCGGGCATGCACACGCTTGGGCTGAAGATACCCCTTTACATACTTAACATAAACAAGACTGAA<br>GCCGAGGATATTATCGCCTACGACCTGAATTGGAACAAAAAGCTGATGCCCGTCAGCGGCACCTACATTCGC<br>ATCTCCGAAAATCATTTCCTGCTCTTCAATAACGCACGATATCCTAATTCCCAACGGTACGCCGACACGGAT<br>GGTTACCCGTTTCCCATTAAGATTAAGGTCAGCTCTCCGGACGAGGATGCCTTTGAAGATGCAGATGTGGTC<br>CTGGAGCTGCTTACTCAGGTTTATCAATTTAGTAGACTGTATTGGAAAAGTCTTCGCCAACAAATGTACCT<br>ATCACCATCAAGTACCCAGAGATGGTAGCCCAGATTGCCCCCCATTTCAACAACGGGGTGCCCGACGATGCC<br>AAGGATGCTCTGTGGTTCCTG |
| 233 | 48 | ATGACTGAGGACTTGTACCTCGACTACGACGCGTTCCTGCGGAGCTTTAAAAGAAACATAGATGTGCCGCAC<br>TCCTTTCTCCTGGGAGCAGGTACATCCATTAGCAGTGGCATCCAGACCGCCTACGATTGTATCTGGGAGTGG<br>AAAAAGGACATTTACCTCTCCAAGAACATCAACGCCGCTGAGTTCTATAAGAACACATAAGGACGAGGCGGTA<br>AGAAAGAGCATCCAAAAGTGGCTGGATAACCAAGGTGAATACCCAGTTCTCGACAGCACGGAGGAGTATTGC<br>TTTTATGCCGAAAAGGCCTATCCCATCCCCGAGGACCGCCGCAAGTATTTTCTGTCTCTTATCGAAATAAG<br>GAGCCCTACATAGGGTATAAGCTCCTCTGTCTGCTGGCCGAGCGCAGCATTGTAAAGGCTGTCTGGACTACT<br>AATTTCGATGGCTTGACCGTCAGGGCTGCTCATCAGAACAAGTTGACGCCCATTGAGATAACCCTCGATAAC<br>TCTGATAGAATATTTCGCAACCAGTCTACCAAGGAATTGCTCACAATTGCGCTGCATGGTGACTACAAATTC<br>TCTACGCTGAAAAATACGGAGAAGGAGCTCGACAACCAGAACGACACATTCAAACAGCAGCTGGGGACGTAT<br>CACGTGGACAAGAATATGATCGTAATAGGCTACTCAGGGCGCGACAAGAGCCTCATGGACGCCATCAGCGAG<br>GCCTTCAGTACGCCGGGGTGCAGGGAGGCTTTATTGGTGCGGCTATGGCGAGACGATCCCCAACGAGGTTAGC<br>GAGCTCATACTGAAAATCAGGTCCCCAGGGTCGCGATGCATACTACATATCAACGGATGGATTTGACAAAACG</td>

TABLE 18-continued

Argonaute and helicase DNA sequences

| SEQ ID NO | Argonaute # | Sequence |
|---|---|---|
| | | CTGATACACCTGTCTAAAAGTGCGTTCGAAGACAACCCCGAGATTACGAAAAACATCCAACTCGCGCTCGAA
AACAGCGCGGACGAAGAGTACTTTAAGACTGACTTTTCACTGAACTTTAGCAAGCCGGATAAGTTCATCAAG
TCAAACCTCCACCCCATCGTGTTCCCGAAAGAAATCTTTCAATTCGAGCTTGACTTCAAGGAGGACAAGCCT
TGGCAACTCCTCAAAACTATTTCACGCGAGACAAACATTTGCGCCGTGCCGTTCAAGGGTAAGGTGTTCGCA
CTGGGCACGCTTACTGACATTGGGAACGTCTTCAAGAACCGCCTGAAGAGTGATATAAAGCGCGAAGCAATT
AGCACCTCCGACGTGGATAATGTGAGTGCCTTTAAATCTCTGATGCTGCAGGCTGTGCTGAAGTTTTTCATT
GGTATCGAAGGCGTGGAGTCCAACCTCAAAGACAGATTGTGGCTTACCAACGCGGAGCAGCTCGTGGGTGAT
ATTAGTGTGCATAAGGCTATCCACCTCAGCCTGTACTTCGACAAAAACAAAGGATTCGCTTACCTGTCCTTC
ACCCCCACCGTACAACTCATCTCTCCTGAGGAAATCAGCAAAATCCAGAAGCAGAGAATCTCTAAGAGTAAA
CTCGAGAAGCTGTTCAATGACAAGTATGACGAGATATTGGAGTTCTGGAACCAAAAGCTCTTTAACAATAGC
CAAATCAAGTTCGAGTACCCGATCAGCTCAGGTAGTGGGTTTGAGTTCAAAATCTCCGCCAACACCGCATTT
GGGGAGATAAACGTATTGGACCCCAACTTTCGCTCCTTTTCCCCTAGAAATTATGACCCGAAGCGCACACAG
TTTAAGGGCGTGCAGTTCCTCGAACCGCAGCTGATATTCCGCAACATCAGTACTAATGTGGAATTTAAGGAC
TACCACCCGATGAGGGGGCTGGTGAACAACCGACCGTTCGACGTGAACCTGAACGGTATAATTCATTCTAAC
GAAATAAACCTCACGGTCATCTGCGGCAAGTCATACGCCAACGACCTGTATGAATTCCTGAGCAAGCTCCAA
GTGAAGCACGCCACTGAGAATGTCAACCCGGACTATCTTATTGAGTATCCGGGCTTCCAAAGTGTGTTCAAC
CTGCCACTCAACATACCCCACTTTGACTCTTCCGAGAAGTGGTACGACATCGACTTCGTAGCTGACAATAAC
GGGGAGAACCACGAGAATGCCATTAAGCTTGCCAGACTCATCACCACCAAGATCGACCAGATTGCCTCTACA
CAGAACCAGAGCACGGTCGTGGTGTTTATTCCAAATGAATGGCAGTTGTTTGAGGGGTACCTGAATCAGGGG
GAGAGTTTCGATTTGCACGATTACATCAAGGCATTCAGCGCTAGTAGGGGCATTTCAACGCAGCTCATCCGC
GAGGATACACTGGCGGATACGTTGAAGTGCCAGATCTACTGGTGGCTGAGCCTCTCATTTTACGTTAAAAGC
CTGCGAACTCCTTGGATTCTGAATAATCAAGAAAAGAACACGGCCTACGCCGGGATCGGTTATAGCGTGACT
AAAAATACAGGACCGGACGAAACGGTGATCGGCTGTTCCCATATTTACGATTCCAACGGCCAGGGGCTCAAG
TATCGGTTGAGTAAAATTGACGACTACTTCCTTGACAATCGCAATAATCCATTTCTTAGCTATAAGGATGCG
TTCCAATTCGGTGTGTCCATACGGGAATTGTTTTACCAGTCCCTGGACAAATTGCCTGAGCGGGTAGTTATA
CACAAGCGGACCCGATTTACCGATGATGAGATCAATGGTATTAAGGCGTCTCTGAACAAGGCGGGGATTAAG
AAGATTGACCTGGTGGAGATTAACTACGAGACGGACGCCCGCTTCGTGGCCATGTCCGTATACCAGAATGCA
CTGCAGGTAGACCGATTCCCTATCAGTCGGGGTACTTGTATAGTCACAAATAAGTACACTGCCCTTTTGTGG
ACGCACGGGATTGTCCCAAGTGTACGGCAGCCAAACTACAAGTTCTACCTTGGCGGTAGAAGCATACCGGCT
CCGATCAAGATCACAAAGCATTATGGTGATAGTAATATAGACGTTATCGCCACCGAAATCCTTGGGCTGACC
AAAATGAACTGGAACTCCCTTGACCTTTATAGCAAACTTCCCTCTACGATCGACTCCAGCAATCAGATCGCT
CGGATTGGCAAACTGCTCTCCCGGTACGAAGGCAAGACGTACGACTATCGATTGTTTATC |
| 234 | 31 | ATGGAAAATCTGACCCTGAATATCATCCCTTTCAGCCACCCCGTGCAGGAGCTTGAGATCGGCTTCTATAAG
CAAGAGAAACAGGGATGCTACAGCCTGTGGAAGGGCGAGTACCCGCAGTCATTCTGGGACGACTTCAACGAG
GAAATGCAAAATTGCGACAAACTCTACACCAACTTCATTGACACGGAAAACTGTGATTACAAAGCCAGTGTG
GACTTTAGCAAAAACAGACGCCTGGCGGTCCATTACTACAGCAGGCTGATCTACAACTACTTTGAAACAGTG
GCAGATGCCGTGAAAATCAACTTCGTGAAAGATATCCAGATATGGTTCAAGGACGAGACCAAGAGCACCGCC
GTCTATACCAGTTACAAGCGGTTCACGATCAAGGTCCAGTTCCATAAGGTGACCGAGTCCCCAGAGCTGTTG
ATCAGCTTCGATGGCAATACCACGGCCTATAACAAAAGTCTGGCCGAGTTGGACGATTTCCCTCCCGAGCTG
ATTAACTACGTTAAGTACAATAACCAAGTGGTAGCGAGGTCGCCGAGGACGCTATTAAGCAGCATATC
GAGGAGCTGTACCCGATCCTGAGCAACCCCATCAGGGACTACCTTAAGATTGCCAGGCCCGATTTTAAGAGG
GGCAACAAGTATAAGCCCTACTACAAGAACATTACAGACTTCTATCACAACCACCTGACTCCAAAGAGTTT
AAAGCTATCCTGCCTATCTCCGAAGACGGTTTCTACAAAATGCCTAAGCACAAGGTTCACAAAACCAGCTTC
AATAGCAATAAACTGAGATTTTTCAATAACACGACATCGTGCCCCACAACGGGATGAAAAACATCGGCCCC
TATAAGGCGTCCCCCCACCCCAACGTGAGGTTCTTCTTCATCTACCATAAGCCAGACCGAAACTTCGCCGTC
AAGACGCTGTACGAATACTTTACGGAAGGGTACAAGAGCCCAGAGGGCTACCTTTACTTCAAGCCTCTCAAA
ACCTACATTAAACAGCCCTTTCTCATCGACAAGGATACCAGCATCGCGTTCGAAAGCCCGGAAAGCGCTCTG
CGCGAAGTCAAGCAGGGTTTGCTTAACCTGGAAAACAGCCCAATACGAAATACGTCGCTATCTATGTGACC
CCCATACATAAGACCGAGACCGACGAGCAGAGGAAGATGCTTTATTACCAGGTCAAGGAAGAATTGCTCAAG
CACGACATATCAAGCAGGTGATATACAAGGACAACATTGGACATAAGGATTTTAGTTTCTATCTGCCCAAC
ATCGCCATCGCCCTGCTGGCCAAGATCGATGGAATCCCCTGGAGGCTGGACAGAGACACTAAGGAGGAACTT
ATCGTGGGCGTAGGCGCATTCACAAGCCTGAACCACCAATATCAAATATGTAGCTAGCGCCTTCTGCTTTAAC
AACAATGGGGAATTCAAGGGATTCGACTGCTTCAAAGCGAATGAAACCGAACTTTTGGCTGGCACCATCGGC
AAGCAAATCCTGAAGTATGTGGTGGACAACGGCGAGAGCGCCAAGCGCCTGATAATCCACTTTTACAAAAAG
ATCAGTAACAAGGAACTCGAGCCCATAAAGAAAATGCTGAACAAGCTGAACCTGACCATCCCCGTAGTGATA
GTGACTATCAACAAGACGACCTCAGAAGATAACGTGGCGTTTGACACCAGCAGCCATAACCTGATGCCCGTG
AGCGGCACCTACCTCAAAATAAGGTATGGGACCAGTACCTCCTTTTCAACACACGATTACAACGCCAGCGAC
ACCGAGAAGGATAACCCCTTCCCTGTAAAGCTGAGCTTCTCTAGCACCGTAGACAATTACTTCGACACAGCG
AAGGTGGTCGAGGAATTGATCGACCAGGTGTATCAGTTCTCCCGCATGTATGGAAGAGCGTGAAGCAACAG
AACCTGCCCGTTACCATCAAGTACCCCGAGATGGCGGCAGAGATCTTCCCATTTTTTGAAGGCGATAAGCTG
CCCGACTTCGGAAAGAATAACCTTTGGTTTCTG |
| 235 | 2 | ATGAACACGCCTTTGACGCATTACGTGCTCACCGAGTGGGAATCCGATACAAATACTAATGTATTGCACATC
CACCTGTACACCCTCCCCGTTAGGAACGTGTTCGAGCAGCACAAGGAGAACGGTAACGCATGTTTCGATCTT
CGCAAGCTGAATAGGAGTCTGATCATCGACTTCTACGACCAATATATCGTGAGCTGGCAGCCTATAGAAAAC
TGGGGCGAGTACACCTTCACCCAGCACGAATACCGCAGTATAAACCCAACAATACTGGCGAGAGGGCCATC
CTCGAACGACTCCTCTTGCGGACAATCGAAAGCGTCCAGCCCAAGAAGGAGATCGCAGCTGGTTCCCGCAAG
TTTACCTGGCTGAAGGCAGAGAAGGTCGTGGAGAACATTAGCATCCACAGGGTAATCCAGTGCGACGTAACC
GTGGACTACGCCGGCAAGATCTCTGTGGGCTTTGACCTCAATCACGACAGTTTAGGAACAAATGAGCGTGTAC
GACCTCATGAAGTCTAACGCCATCTTTAAGGGAGACCGCGTGATAGACATTTACAATAACCTGCACTACGAG
TTTGTAGAGATTTCCAACTCCACAAATAAATGACTCCATCCCCGAGCTCAACCAAAGTGTCGTCAACTACTTT
ACGAAGGAGCGAAAGCAAGCATGGAAAGTGGATAAGCTGGAACAGAGCATGCCAGTCGTGTACCTCAAGGCA
TTCAACGGCAGTAGGATTGCATACGCGCCTGCGATGCTCCAAAAAGAGCTGACCTTTGAGAGTCTCCCGACC
AACGTAGTACGGCAGACGTCAGAAATATTCAAGCAAAATGCCAATCAGAAAATCAAGACCTTGCTGGATGAA |

TABLE 18-continued

Argonaute and helicase DNA sequences

| SEQ ID NO | Argonaute # | Sequence |
|---|---|---|
| | | ATCCAAAAGATTCTTGCCCGCACCGACAAGATCAAATTCAACAAGCAGAAGCTGTTGGTTCAGCAGGCCGGC TACGAGATACTTGAACTGTCCAACCCAAACCTCCAGTTTGGGAAGAACGTTACTCAGACGCAACTGAAGTAT GGACTGGATAAAGGCGGAGTTGTGGCCTCCAAGCCGCTCAGCATCAATCTTCTGGTCTACCCGGAACTTATA GACACCAAGCTCGATGTGATCAACGATTTCAATGACAAACTGAACGCTTTGTCCCACACAAATGGGGCGTGCCC CTGAGTATCCTGAAGAAGTCTGGAGCGTACCGCAACAGACCCATTGATTTCACTAACCCCCACCAGCTCGCG ATTCTGTTGAAGGAACTGACCAAGAACCTTTTCCAGGAACTCACGCTTGTGATAATACCGGAAAAGATCAGC GGCATGTGGTACGATCTGGTTAAAAAGGAATTTGGCGGCAATAGCAGTGTTCCGACGCAATTTATCACCATC GAGACACTTCAGAAGGCAAACGACTATATTCTGGGGAACCTGCTCCTTGGCCTCTATAGCAAGTCCGGCATC CAACCATGGATTCTTAATAGCCCCCTTAGCTCCGACTGCTTCATCGGTCTGGACGTATCACATGAGGCGGGT CGCCACAGCACCGGGATAGTCCAAGTCGTAGGAAAGGACGGGCGCGTGTTGTCATCCAAGGCGAATACGAGC AATGAAGCCGGCGAGAAGATCCGCCACGAGACCATGTGCCAAATAGTGTATAGCGCCATCGACCAGTACCAG CAACACTACAACGAGAGGCCTAAGCACGTGACCTTCCACCGCGACGGTTTTTGCAGGGAGGACCTGCTGTCA CTCGACGAGGTGATGAACTCCCTGGATGTCCAGTACGACATGGTGGAGATCATCAAAAAAACCAATCGGCGA ATGGCACTGACCGTCGGCAAACAAGGATGGGAAACCAAGCCAGGACTGTGCTACCTGAAGGACGAGAGCGCC TATCTGATCGCCACCAATCCGCACCCGAGGGTGGGCACCGCGCAACCCATCAAGATTATCAAGAAGAAGGGG AGCCTCCCTATCGAGGCCATTATACAGGACATCTACCACCTGAGCTTCATGCATATCGGCTCACTGCTTAAG TGCCGATCTCCCCATCACAACTTATTACGCCGATCTGTCTAGCACCTTCTTTAACCGCCAATGGCTTCCGATC GATAGTGGCGAGGCCCTTCACTTCGTG |
| 236 | 35 | ATGATTAACAAACTGCAATTCGACGAGTTTCAGAGGGCCATAGGTATTTCTAAGAACGACACCTTCAGTCTT TTGCTCGGAGCGGGTTGCAGCATCAATAGTGACATCCCTAGCGCGGAAGACTGTATATGGGAGTGGAAGCGA GATATTTACAAAACAAATAACAGTTCTAGCTTCGGCTGGATTGACAATTACAAGAATCCCAAGACTCAGGAG ATCATTCAGAACTCGCTCAACAACCAAGCCATCTATCCCGAACGCGCCTGCAAAGAGGAGTACACCTTTTAC GCCTACAAATGCTATCCCATCGACGAACATAGGCGACAGTATTTTCAGAAAATCTGTAGTGGTAAAAAGCCA TCCATCGGGTACAAACTTATTCCCCTGCTTGCCCGAAAGGGCATGCTTGATAGCGTGTGGACCACGAATTTG GACGACCTCGTGGTGACCGCCTGTATAGGCAACGGGATCCAGGCGATCGAAATCACGCTCGACTCCGTGCAA AGGTTGAACAACCGGCCTCAGAACCGACATGAGCTTCCTGTGATCAAACTCCACGGAGATTTTAAGTATGGC GATCTTAAAAACACCGAGGAGGAACTCCTCAATCAGGATAAAACGTTCAGGGAGAGACTTATTGAATACGTA CAAGACAAGCACCTGATCGTGCTCGGCTACAGTGGCCGAGACACCAGCCTGATGGACACACTTAAAGAGGCC TACTCAAAACAGGGGGTGGAATTCTGTACTGGTGTGGATATGGTGACAACATAAACTCCGACATCGCCGAA CTGATTCAAATAGCCACTAAAAATGGCCGACGAGCCTTTTACATCCCCACTGATGGTTTCGATTCTACGCTC CGGAAAATCACACAGATAGTGGTCGAGGATGATAACAACCTGAAAAAAGAGCTTCTCGAGCTTCACCAGACC AGCAATATCAATGACACTATCACACCTTTTGATCTGAAGTGCGAGAGGGTGAATAAGCTGTTGAAGTCAAAC ATATTCCGGATTAGCTTTCCAGACGAAGTGTTCGTTTTCGATGTGAGCATCAGCGATAAACCCTGGAAGTTC GTGGACGAAAGGACTCTTGAGCGCAACGATATTAGCGCCGTTCCCTATAACAAGCAAATCTGGGCATTCGGT AGGCTTGACATCATAAAAGACATCTTCAAAGACGTGATGAACTCAGACATTCAGCGAAAACCCCTGGCAAAC ATCAAGATATACAACACGGCGGTTAGTCGGCTGTTGCTTACTACGATTTGCAAGATACTGGCGCTGCAGAGC AACCTTAAGACCGACTATAAGGGTAAGTATGGACCGAGAACAACAGTAAGTCCATTTCCGGCCACATAGTA TACAATGCCGTGCTGCTGTCCTTTGATCGGATAAGCGGTGACTATTACCTTAGCCTCAACCCCGACTTCGTG CTGGCTAACCCCAACATTGAGAAGAGTACCATACAGACCATAGGACTGTTCTTCTTCCAGAAGCTGTGGAAT CAGCAGTTTAACGAGTACATTAACTATTGGAGGCAAATTTTGTTGAAAAAGAATAATGAGTACGAGTTCCCC ATAAATAGCGGAACCGGCTTCAAGTTCAAGATCAAGAACATCCCAGTGTTCACTAACATCTGCGACCTGAAT AACCCCTCGCATCAACAATCACAACGTCTCCAGCCACCACTGCTGCTTCAGGGGGTGCAATTTAAGGAAATC CCGCTGCTTTTCAGCACCAACAATGGCAACCGCACGGCCACCGACACCCACCCTATGAGAGGACTTCTCATA AACAAACCGTATGAAACGGGCGTCAACGACTTCCTGAAAAGTCTATCACCCTGGGAATCATAAGCCCCAGT CAGGACGCCCTCAGGTTCTACCAATTCCTGGAAAACCAGAACTCTAAAATCAAAAAGCACAACGACAAGGAC AACTACATAATAGACTACGAAGGGTTTTTCGCCATCTACGGCGTTAGTCTCAGCTTCCCAACACCTAACGAC AACGAGTGGGAAAGGATCAACGAACCGCTGATTATGGGCATCAAGGAGACCGCCCAACAGATAAAGCAACTG ATATGCGACAGCATCGTGAAGATCTCAAGCACGACCAGGAGAAAAATCATCGTCATCTATATCCCCAACGC TGGGAGCCCTACACCTCTTACCAGCTCGATGGTGAGTCATTTGACCTCCATGACTACGTGAAAGCGTTCTGC GCGGAGAAAGGGATTATGAGCCAACTCATTGAGAGAAGACCATTAACGATACTATCCAAAATGCCAGATA CATTGGTGGTTGTCTCTGTCATTTTTCGTAAAATCCTTCCGGACCCCATGGATTCTCGCAAATACTAACAAC ACCACCGCCTTCGCGGGTTTGGGGTACAGTGTAGAAACAAGAAGGATATTAACGGACATATTGTGCTGGGG TGTAGCCACATTTACAGCTCAAACGGAGAAGGGCTCAAATACAAGCTGGCCAAAATAAGTAATGATAAGATT CAGTGGAGGCATAAGAAGCCGCACCTCTGCTACGACGACGCGTATGAGTTTGGCAAGTCAATTGTGAACCTG TTCTACGAATCTATGAACGAACTGCCAAAAAGGGTGGTCATCCACAAGAGGACCTTCTATACCGATGAAGAG AAACAAGGGATCATAGACTCCATTAGCGACAATAAGAAAATAGAGAGCATCGACCTCATCGAGATCAACTTT GAAAACAATATAAAGTACGCCTCTAGCAAAATCCACGACGGAAAGGTAGACATTGACGGATTTAGCGTATCT ACGGGAACCTGCATACAACTCAGCTCTAAGGAGGCGCTCCTGTGGGCGCATGGAGTGATTCCTAGCGTCATT AACCCTAACTGGACTTCTACCCTGGCGGCAGGTACATACCTAAACCACTTAGGATCATTAAACATTACGGT ACAGGTAGCTTGGAACAGATCGCGAACGAGATTCTGGGCCTGACTAAAATGAATTGGAATAGCCTGAACATG TACAGCCAATTGCCTGCCACAATTTTCAAGCTCCAATGATATAGCTAGGATAGGTAAATTGATAGGGGCGAAC AGTATGCACGAATACGACTACCGATACTTCATC |
| 237 | 9 | ATGAATAACATACCCATCAGGCTGAACTTTTCGCCCTGAAGAACCAGAACATTAGCTTCAGGATCTACAGG CAGGACTTCAACGGCCAGAAAAACAGGACGGGTACTACAGGACCAAGCTGCCCATCAACGACTCTTCTGAC ACCTACGCGGAGTACTGGGTGACAACCCAGCCCAAGGATGGCTTCGAGAGGGTGTACTGCCTGGGTTCCTCA AACCCTAAGCTCACCGTCCGAATCATGTGGGAGAGCTTCCTGGATAGGGTCCAGAAGTCCCTGAGCTCCGAC GAATATATCCTTTACGGTAACGGATTTAGCCGGAAGGTCGCCGTGATCATCGGCAGGCACAGGGAGGGCAAT GAGGTGATCCAGATAGAGCCCTATTACCCTGAAGGCCGAGAAGAAGTTCGGCTTTCTGTTGGTGGACTTCGCATTT AAGAAGGCCAAGGACGTGCCCTATAGCATCAGGGTTCAGCAGCTGAGCCTGTCACTGAAACAAGTATGGGAAG AGCAACGCCGACTACTATAGCGACAAGCTGGATAAGATAAAGTTCTTTATGCAGAAGTTTAAGCAGAGGCTT TTCCCATTTAGCTTGGATAACGAGGATTACGACATCGAGAACGAGCTGTATCTGATGAGGAGCTACCCGCTC AAGATGAAGACCTACATATTCTCTAATGGCAAGGAAAGCAACAGCCAGGTGCAGGGTCTCAAAACCTACGGA CCGCTGGCGAATCTCGATAAGGAGCCACTGTTCGTGTTCATGTTCGAGTCCCAGGACAGGAACGAGGCCCTG |

TABLE 18-continued

Argonaute and helicase DNA sequences

| SEQ ID NO | Argonaute # | Sequence |
|---|---|---|
| | | GAGCTCTATTCTAGCCTGCTGGGCAAGACGTACACCAACATATTTGCTGGCATGGAGAGCGTGTACAAAATC<br>AAACTCGCAAAAGAGAATGTGAAGCACATCATCATCCCCAGCCTTACCAAGGAGGGTCTGCAAGTGGTGGAG<br>CAAGAGCTGCAAACTATCGTGGAGAGTCATCAGGACAAGAAGGTGATTGGGATATTTGTAATGAATGAAAAG<br>GTGCCCTCATCCATCACCGGTTTCAGCCCCTACCACTACGTCAAGTACATCTTCACAGAGAAACGCATTCCC<br>CTCCAGACAGTGAGGTGCGAGAGGATCGCTGCCAGGGATGGCCTCAAATGGAGCGTTGGCAACATCGGCCTC<br>CAAATTTTCGCTAAATTGGGCGGCATCCCTGGAAAGTCAAGCCGAGTAACGATAAGTGCATCATTTTTGGC<br>CTGGGCTGCGCCCACAAAAAAGACGAACTGGGAAACATTAACAAATACTTCGCCTACAGCGTGTGCATGGAC<br>AGCAGCGGCATTTACCGAAAGATTAATGTGCTCGGCGATGCAAAGGAGCGCACTGATTACATCCTTCAACTG<br>CGGGAGAACATCAAAAGCGTGATAAGCGAGAATCTGGACGGGAGCATTGAAAAGTGCGTGATTCACCTGCCC<br>TTCAAAATTAAGAACGACGAGATCAGGTACATAAAATCCAGCGTGCAGGAGATCGCGCACCTGTATTCCGAC<br>ATAGAATTTCAATTTATCAAGATCAACACGGACAACAAGTTTTTCGGATACGCTGAAAACAACAGCAAGGTA<br>CCCTACGAGAGCAGCTACATACAACTGAGCAGCAACGAGTTCCTGGTGTGGTTCGAAGGCCTGCAGTACGGG<br>AAGGAGCTGGTGAAGAAAAAGGTAGGTAACCCCGTGCACATTGAGTTCATGCAGATCGATGAGTTGGATCCC<br>GAAAAGAAGCGGCGATATCTGCAGGATATCATAAACCTGAGCGGTGCCAACTGGCGAGGTTTTAACGCCAAA<br>CTGTCTCCAATCAGCATCTACTACCCCAACATCATAGCCAATTTCATTTCAGAGTTCAGGGAGTTCCAGCCC<br>GAAGGCGACGTGGACCTGACCAACTTTTACATTCCCTGGTTCCTG |
| 238 | 10 | ATGCATAACATCGAAATCAACACCTTCGTCAACAGCTTTGCCATTAAACCCAACAACTCCATGTCCTTCCTG<br>CTCGGCGCAGGCGCGTCTATATCCTCCGGGATCCTGTCTGGCGGACAGATGGTGTGGGACTTTAAACGGAAC<br>CTCTATTGTGCGTCCAAAAACATACGCACCAGCAATTTTCCCGATATGAGCAAAAAGAATGCGCAGGACGA<br>ATCCAACGCTTTTTTGATGGGCAGGCCGGAAATCCTAGCCTGTGGTCCTCCGAGGAGTATAGTTTCTACTTC<br>GAGAGGTGTTATCCGGCGAGGAAAGACAGGGAGCTGTACATACAGAACAAGGTACGAGACGTCAAGCCGTCA<br>TTGGGGTATCTCTGCCTCGGGGAATTGATCATACACGAGAAGATCGGTGTAGTATCAACCACAAACTTTGAT<br>GACCTGGTGTTGGCCGGCATCCATTCAATAAGACCGGACCTGAGTGTGAAGACCATCAGCAGTGCCCTCAAA<br>AATAGCACGGGATTCTTCGTGAACGACGGGTTCCCGAACATCATTAAGCTGCACGGCGATTACTTGTACGAT<br>AAGCTGAAGAATACCGATAAGGAGCTGCAAAAGCTCGAGACGGAGATCAGCGGAATTTTTCGAGATGCCGTC<br>AAGAGTGGCGGGCTCATCGTACTTGGCTACGCCGGCAACGACAACAGCGTGATGAGCGTCCTGGAGGAGCTC<br>GTAAGCTCCGGGCAAATCAGGTACGGCGTGTTCTGGTGCCAACCGAAGGGCTTCCCCCTGTCCAAGCGACG<br>CGGGAGTTTATTGAGAAGGCTTGCGCCTACAATGAGGAATCCGGGGTTGTCGAGATCAACAATTTTGACGAC<br>TTTATGTACCGCCTGTTCCTTACACTCAACATCCAAAACTCATTTATCGACAGCATGTGGGAACAGAGCGGC<br>ATGAAGCAGCCGATCCTCTATGAGAATATCGGACGACACAAGTCCACCGCCGTGACGAACGCCCTGTGCGCC<br>CTGCAGTACCCCCGAAAATGCTACGTCTTCAACGCGAATATATCAAGCTGGAAGGAACTGCGCGAGACGATA<br>AACGACACGTGCGTGGCAGTGCTGTATAAGGGCATGGTTTGGGCGCTGGGCACGCAAAGCAGGCATCGTGCAT<br>GCGTTCGCCGGGAAGATCAATGGAGACATATACGAACTCGACATCCCGTTGTACATGATGAAACATCGAGGAT<br>TCTGACATCCTGGGCATGTTTTACGACATCATAGGACGCGGCCTTCAGCGAAAGGGGCTGGTGAGCTACGGT<br>AATAGGAAACATCACAAATACTTCAACCCCTCCAGCAAACGGTTCAAGAACGGTCAAAACATCTACGACGCG<br>GTCAAGATATCACTGAGTTTCGTGGACGATCAGCTCGTGCTCATCCTGCTGCCTACGGTGCATCTGCTGAAA<br>CGCGACGGGACGGAGCTGGAGAAATTTGACTACCAAAAATTGGTGTCCCAGGAGATGGCAACACACTACAAC<br>AAAGTGGTGGACAGCGAGATAGAGATCTGGCTGAAATTCATCTCTAATAACGGCAAGATAATCTTTGAGCTG<br>GGGAACGCAATACTGGAATTTAACAACGTCCGCATCCAGTACTCTGGTAACGGTAACCTCAGCAAGTGCTAC<br>CAGGTGAGCGAGCCCGAGCTCACGTTCAGTTACGAAAAGGCAACTGCATCGCTACCAACCAACTGCGGGGT<br>CTGATCAACTATGGACCCATAGAGACTTACGTGAACAAAGCCATCAGGTTGGCTGTACTCAGCCCTAAGGAG<br>TGTGCCGCGGACATTTGGAAACACCTGCAGAAGTTGAATGAGCATCACGTCACCTCCCTTATTCAGGATGCA<br>AATTTTCTGCCGGAGTACACCGGCTTTCAGAACGTTTTTAGGTGCAACCTTGACATTCCCAATGGGAACGAT<br>GTGCATAGGTTCAAAGGCTACAGTATAGACAAGGTCATGCAACTCAACGCAAAGAGCTACTTTTACGGGATC<br>TGCAAGTACATTGATGCATTCGAGACACAAAGGAGCCAATACGACCTCCTCGTCATCTATATACCTAAGCAG<br>TTGACCCACATCCGAGAGGCCAAGAATAACTTCGAATATTCGACCTGCACGACAGCCTGAAGATTTATTGC<br>GCTGGTAAAGGTATAGTCACGCAGATCATCGAGGAACACAGTGTTTATACTAACAATGACACCGCCAAGATC<br>ATATGGGTCTCTCAACGGCCATATTCACCAAGACGCGCCGGAAGGTTGTGGAAACCCAGACGCTATTCCATG<br>AACACCGCTTACGTCGGCCTGTCATATGTGCAGAGCGTTAAGAACAACGAGAAAGTCAGCATCGGTTGCAGT<br>CAGCTGTTCGACGCCAAGGCAATGGAATGAAGCTTTACCTGAGACCCTTGATGAACCCCCAGATAATTCAA<br>AATAACCCTTTTATGCGGAGCGACGACGCTTGCAGGCTTATGTCAAACCTTAAGCGGATGTATGACGACAGT<br>GTCCGCTCTACAAAACTGAATAGGATCGTGATCCACAAAACTACGTTCTTCACTAAAGAAGAGATGGAAGGC<br>ATCACCAAAGGGCTGGCTGGAGTGGATGACATAGAGTTGCTCCAGATCCAGGAGTTCACAGCTTGGCGAGCA<br>ATACGCTTCGACTACGACAAGATCGCACCGTTTCCGATACAGAGGGGCACAGTGATTCTGGGGTGGGGCCAC<br>TTTAGTTACTTGGATACCTGGAAGTGTACCACC |
| 239 | 7 | ATGAACGCCGTGACCGTGGGCAGCACCCCAAGCGCCCAGGTACTCGTCGGTGTTCAGCCATACGACGAAACC<br>ACCCTGGAGAGCCTGAGAAGTAAACACCGCGGAGACTATCTCTTTAAAGGGGGGAGAGAACGGCGATAGC<br>ATACTTGCTGTGGCCCTGAAACCGAGTCTGCCGGTCATCGGAGCAACCGAGGAGGATGTAATTCTTGCCGAG<br>AGCCCATGGTTGTTGGCTCCACTTGCCTTGGAGACTTTGCTGCAATGCTTCGTGAGGCTTCAAAGGCCCATC<br>CTGAAAGCTAGGCATCCCCTGAGAGTGCTCTCACAAAAACCGGCAAATCTTTTCCCAGCCGATGCGGGGGTC<br>CCCCAGTGGCTGCAGAGGAGACTGGTGCTGGAATTCGACACGCGCACTGTTAGGGACAGGTCAGACGCTGCC<br>TCTGTCGTGCTGGCATGTGGCGTGAGGACTCGGAATTTGATTGATGCCGACTGCGCGACACTGATAGCAGCC<br>GGTGTCCCCCTTGTGAATCGATACGTGGTGACGAGGCACCCTGCGGATGATCCCCGAGTGCAGGGCTATTTG<br>AGGCTCGCCGGGAGGGTGACCAGGATAGATGGCCCCAACCTGTACTTGGAGGATCATGGCGATGGAGCAGCT<br>GTGATCAAGGCCTCCATGGCCTATCTGGAGCCCAGGAGGGAGAACGTGATTTGGTGTGCCCCACCATTTGCTG<br>GGGAGAAATGCGGATAGAGTACTGGCGGAAGCGGATAACGCAGCCGCAAAGCACTTGAGCGGTCCCGAACGA<br>TTGGCCGTAGTGAAGAAGACTTTCGACTACCTTAGGAGCAGAACATCGAGCTTGCGCCTGGAGTGCCCCTC<br>ACTCTGGGTAACGTTGTGGGGAATGACAAGGGTTCTTTGATCTTCCGGACGAAGTCCTGCCCAAGCCCCAC<br>CTGGTGTTCGACCCGAGCGGGACCCGGATCGATAGGTGGAATGAGAGGGGATTGGACGCTCACGGGCCCTAT<br>GATCAAAGGACCTTCACCCCTAAACAACTCGAGGATTGCCGTCATATGTCAACTGCCCTACGAAGGCCAGGTC<br>GATGCGTTCCTGGCAAAATTTCTCGACGGCCTTCCAGACGTGAAGACCGGCTACGGGGACCGGGCCAGGGCG<br>CCTTATGCCAAGGGGTTCATCAGGAGGTACGGTCTGGAGAAGCCCAAGGTGAGCACCTTCGCAACAAAAGGC<br>GCTACTGCTAAGGACTATGCCGCTGCATGTAGGGCGGCTGTGGAGGACGCAACCGCAAGCGGCTTCGAGTGG |

TABLE 18-continued

Argonaute and helicase DNA sequences

| SEQ ID NO | Argonaute # | Sequence |
|---|---|---|
| | | AATCTGGCTATCGTGCAGATCGACAAGGATTTCAAGGAGCTGAGTGACGTGGAGAATCCCTACTTCACCACC<br>AAGGCCCTGCTGCTGAAGCATCGGGTGCCCGTCAAGAGGTGACGCTGGAGACGATGAGGTTGGCAGACGAA<br>CAGCTGGTGTACGTGTTGAACAACATGAGCGTAGCCACCTACGCCAAAGTGGGCGGTACTCCCTGGCTCTTG<br>AAAGCGCAACCAACCGTGGCCCATGAGTTGGTAGTTGGAATCGGAAGCCAGACTTTTAGTGCCTCAAGGCTG<br>GGTGAGAAAGAGAGGGTTGTAGGCCTTACCACCGTGTTCTCCTCCGACGGGAAATACCTGCTGGACGACCGG<br>ACTAGCGCCGTTGATTACGACAACTATAGCGAAGAGCTGTTTAAGAGCTTGTCCCGGTCAATAGAATCAGTA<br>AGGATCGCCGATAACTGGCGAAGTACGGACAGTGTCAGGCTGATTTTCCATGTTTTCAAGCAGATGGCGGAC<br>GAGGAAGCCGACGCGGTTGACAAGTTGGTGCAAAAGCTGGGTTTGGCACAGGTTAAGTTCGCGTTTCTGCAC<br>ATCGTGGATGACCACCCATTCGCCCTGTTTGACGAGAAGAACATAGGTACAAAGACATGGGGTGGGATATTC<br>AAGGGCGTCTTGGCACCGGAAAGGGGCCTCGCGGTAAACCTCTCTGGGGCCGAAACCCTGTTGTGCTTCACA<br>GGCGGCAGGGAACTGAAACAGGCGAAGGATGGCCTGCCCGTGCCTAGTCTGCTGCGACTGCACCACAGGAGT<br>ACGTTCAGGGACATGACCTACCTGACGGGGCAAGCCTTCAACTTCGACTGTCACACCTGGCGCATGTTCACA<br>CCCGCTCCTGTTCCCATCACAATACATTACAGCGAGCTGATGGCGCGACTCCTTACGGGCCTCAGGCACGTC<br>CCGGATTGGGATCCAGACACAATGCTGACCCCCATCAGTCGAACCCGGTGGTTCCTG |
| 240 | 13 | CTGGACAGTTTCCACCTCGTGCAGACAGAGAAAAAGGCCATCGCAATGCCAAAGCAGAAGCTTGCCGGTTAAT<br>GCACTCCCCATTAGCCTGAAAGAGCAGGAGCAGCACAAGCTGTTCTTTTTTAGCAAGGAAAAGCAGGGCGAG<br>CGAGCCCCGCTCACCAGGAAAGAATATCCTGACAGCTTCGCCAAGAGGTACCCCAAGAGCTCCAAAGAGTAC<br>GACGTGCTGTACACGGACTTCACCCCAGAGCCAGCTGAGGATGGGTTTGAAATTGATATCGACCTGGAGGAG<br>GCACCTGGCCTTGCCAAGCACTACTTGCACAAAAGGATCTTTGAGGCCTTTAAGGGAGTAGCTGACTTCAGA<br>AAGCGGGATTTCATCAACGGTGTGGAGCTTTGGTTCAGGGACAAACCCGCCGACGAAGTTAATTTCCGGGCC<br>TACAAGAAGTTTAAGATTACCACCGCAGAACTTGGTTCTCCGCAGGCTGGGCCCTGTTCATACAATACACC<br>GGCCATTCCTTTATTCACCCGGTGGCGATCAATAGCGAAGAGGCCGCAGTGGACACTACGGAACTCACGCGG<br>GTTGCTTATAACCGACACATCTTCCATCTACGAGGAGATCCCCGAAGACAAACTGAGTGAGATAGATTTCAGT<br>AAGATGTACCCCGTGGTGAACTTCAACATTAGGGATAAAATGCAGCAGTTCCCCGTTATCGATCCATTCAAA<br>ACAAGGTCAAGGAATATGTCGACGAAATAGACAGGTTCAAGAACATGTATCTGATCGCGCCAGCGGTTGAG<br>GAGGTGCTTCCGTTTACTTTCAACGACGACAACTGGTGCGAGATCAAGATCGGCACCTACCATACCGTGCCC<br>AATGCGGTTCCAAATTGGTTTTCCGCGATGGGCAAACCGAGATACACCCGTTCTACGGTATCAGGAACCAC<br>GGCCCTTTCATGCCCCCAAACACAGCCACATAAGGTTTTTGTTTATCATGAGCAAGAGGGACATCAAGGGC<br>GCTGGTAAGCAATTCTATGAATACTTGAAGGGGGAGGTAAAAGGAGTGGACGGGTTCAACAGGTATGCTAAT<br>ATACCGTCATCCCTGAGGGGTGAGATGATCGAGTTTGAGAACGAGCAAAACCCCCTGCCGGAGATTATCGAC<br>GGCTTGAACAACATGGAGCGAGAAGCGGGCGTGGCCTACTTCGCCTTCTATATCAGCCCCATCGACCGAGAA<br>GTGAGGAACAGGAAGGAGAGGTTGGTGTACTACAGGGTTAAGGAGGAGCTGCTGAAGAGAAAGATTGCCTCA<br>CAAGTGGTAGAAAGGAGCACTATCGAGAAGGCCGACTTCCGCTACAGCATCCCCAACATCGCCGTTGCCACA<br>GTGGCCAAGCTGGAGGCATCCCGTGGAAGCTTACTCAACCCCAGAAGCAGAGCTGATCGTGGGCATAGGC<br>GCATTCCAGCCACGCGAGTTCGACAAGCGATATCTGGGCAGCGCCTTTTGCTTCCAAGGCGACGGAACCTTT<br>AGCCGCCTGAGTGTTTCACCAAGGACGAACCCCATATGCTTGCTGGCAGCATCAGGGAAGCGGTTCAAAGG<br>TACGCCGATGAAAACAGGCAAGTGGAACGGCTGGTTATCCATTTCTACAAAACCATGAGCTATGACGAGAGG<br>AAGCCGATCCTGGCCACCTTGAAAGAACTCGGCCTGGACATTCCCGTTGTGGTGGTCACTATCAACAAGACT<br>GAATACGAGCAGACAATCCTCTTTGACCTGAATTCTAGCATGAGGCTGCCGCTGAGTGGTACCTATTTCAGC<br>CAGCGCAGGGACGACATCCTGCTGAGCAACAACACCAGGTACCGCAAAGACAGCGAGGTGAAGAGGGGTTTC<br>CCTTTTCCCGTGAGACTGCAGCTGTGGTGCTCCAAGGAGGGCCTGCTGGACGACGAGGGTTTAGGGAGCGA<br>CTGATCACCCAAGTGTATAGGTTTTCTCGGCTTTACTGGAAGAGCGTGTCTCAACAGAATCTGCCCGTGACC<br>ATTAAGTATCCCGAGATGCTGGCCGAAAAGTTCCCATACTTTAACTCAAGGAGCCTTCCTAGCTTCGGCGAA<br>AAAAGCCTGTGGTTCTTG |
| 241 | 3 | ATGCTTATCTGGCAATTCAAGAGAATGCTCTACTGCCAGGCCAACAACATCAAAGAGGAAAAATTCAAAGAC<br>CTGGAGAGCGAGCGAAATCAAAACACTATCCAGAGCTATTTTGACCTGAAGGGCGGCTATCCGGAAAGATAT<br>AGCCAGGAGGAATACTCCGCTTATTTCGAGCATTGCTTCCCGAAGTCTATCAACCGGAAGTATTTCATGCAG<br>AAAATAGTAGAGGGCCGAAATCCGAGCATAGGTCACAAGTGTTTGGGTGCCCTGTTCGACTGCAAAAAGGTA<br>AACCACATCTGGACAACCAACTTCGACGAGCTCATCGAGAATGGGATTAAAAGCGTCAACAATGCCAGCAGC<br>TTCGAGGTCATTAGTATCGACAATCAGAGGCAGCTGGCCAACCTCAACAACTACCCAAGGGTGGTAAAACTT<br>CACGGCGACTACAGGTACGACAAGCTCCAAAATACCGTTGACGAACTGCAGACGCTGGGAGAAGGACCTCCAT<br>AAGTACTTCGCCGATGTGCAAAGCAAGACCGGCTGTGATTGTGATAGGCTACGGCGGAAACGACCAGAGCATC<br>ATGTCCGCCTTTGAAAAGACTTTGGAGGCCGACAACCCGTTCCCGTTTGGGCTTTACTGGTGCGTGAGGACG<br>GGCCAGAAAACCAACAAGAAGGTAATCGAATTCATAGAGAAGGTTCACCAGAAGAACAAGGAAAAGCTTGCT<br>GCGTTCATCGAAATCGACTCTTTTGACGATTTTCTTTATGAGCTGTGTATAAGACGAACAACCTTGCCAACGAT<br>CACATTGAAAATATCGCCAAAAGCCGCTTCGAAAAAAGGAAGGCTTTTACAGCCCCCCAGATCGGCACCTCC<br>TTTACGCCTATAAAGCTTAACGCCATAAAGGCCAAGACTTACCCGAAAAGCATCTATTCCTTTAAAACTGAC<br>CTCAAGGGGGGCAAGGATGACTGGGATAAACTCAGGGAAATCATTAAGGACCAACCGGTGAGCGCGGCTCTG<br>ACCAATGAAAACACGGTCGCCTTCGCAAGTGTCAACGACATCAAGAAACTCTTCTCACACACACTGAAGTCA<br>GAGATCACCACCGTGGACATAGATGACAAGTTGATCTATCGGCAGGAGTCTTTCTACCTGGGCATGCTTTAC<br>GATCTGATAGAGCACAACCTCCTGAAGAAGTTCAAGTTGGAGAAAGTGCCCAACAATAGGCTCCGCAAGTAT<br>TATAGCAAAAACTACAAGCTGAATACCGAGGAGCTTCAGAAGTCCAAGATCAAGACCAGCCTGTCCGTCTAC<br>GAAGCGTTCGAGATTCAAATAGAATTCCACAATAAAGAGCTGTTCCTCATTATCCTTCCGTCCATCCACATA<br>GACGACAAAGCCGGGCTGAGCCGATTTGAGAACACAGGAGATAGCCAATAAGATCATAAGCAAAAGGTGGAAA<br>CGCATGGTTAACAACCAGCTTAGGTTCTGGCTGGGGCTCCTTAAGAACGATAACACTAACATAGAGTTCAGC<br>ATCGACAGTTTCAAGATTGATTTGGAAGAAAAGTTCTCCGGCGTCGGGAGCTTTACATCCTCTTACTACATC<br>TTTAAGGGCGCGTTTATTTCCAACGAACCCAAGCTTAGCTTCCATATCTCCGACAGCAATTACAAAACAGTG<br>CACCCCGTGAAAGGCCTCAAGAACTTCGGTCCACTGGATTACTCATTTGAAAGCAAACAGACCAATCAGCAG<br>GCTATTAAACTTGGTATAATCACTCCGATCAGCGGCATGCAACGGATACTCAAACACCTGAACGAACTTAAT<br>AACGAGATCCGCGCAGCTACGGAAAAGGAGTACCTGACCGATTATTACCCCTTTAGCAACATCTACAAGAGA<br>TACCTTGACATCCCGCAGAATAAGGATAGTAAATTCTTGGAACTCGTGAATGAAGCCGAAGTGAACAAACTG<br>AACCACCTCGAGTTTTATGACTTCCTCAAACGCAAAATTGATTACTTCTATACAATTAGGGGCGAGTTCGAC<br>GTGCTTGTGTTGTATTTTCCCAAAGGCTGGACTAAGTTCCGCGAGCTGAAAAATGACAGTGTCTACTTTGAT |

TABLE 18-continued

Argonaute and helicase DNA sequences

| SEQ ID NO | Argonaute # | Sequence |
|---|---|---|
| | | CTGCACGACTCCATCAAGCTGTACTGTGCTAAGAAGAATATCAAGATCCAATTCGTGGAAGATAAGAGTATA<br>GACTACCTCGACCCGGCCAAGGTTAAATGGTGGTTGAGCCTCGGCTTGTATGTCAAAGCGAACGGGCTGCCC<br>TGGCGGAACGTGGTCGTAAACGAAAGCACCGCGTTTGTCGGGCTCGACTTCGCGGTCCAGCGAATAAACAAC<br>AGTAACAAGTACGTGCTGGGTAGCTCACAGATCTTCGACAGCTCCGGACAAGGACTCAGGTTTCTGTTGCAG<br>CCCATCGAACACCCTGTGTTTATCGGTAAAAACCCCTTCATGAGCAAGGAAGATGCGCGACGGATGATTCTT<br>AAATTGAAGGAAGCGTATTTTAGGATTGACGGTAACTCCAAGCTGGAAAAACTGGTGGTGCACAAAGTACTG<br>CATTACACAAATGATGAGATGACCGGCATTTCCGAGGCGCTGGAAGGTATTGAGAACATTGAGCTTCTGCAA<br>ATACAGAAGTATAGTAAGTGGAGGGCAATTAGAGGGGACATCGATCGGTATACGGGAAAGGTGAAGACCGAC<br>CCGCACAATTTCCCGATCCAACGGGGACAGTGATCCAGCTCGACGACTTCTCTTTCCTTCTGTGGACACAT<br>GGAAGTGTACAGGAAGACGACGTGGCTGGTAGGCACATGAATTACTACCAGGGTAAGCGCGGGATTCCCGCA<br>CCACTTCTCATACGGAGGTTTCGCGGCACCGATCCGATTGAAATGACCGTGCGAGACATCCTGTCACTCACC<br>AAGATGAACTGGAACGGAGGCGAACTTTACAAGACTCTGCCGGTGACCCTGGATTTCTCTAAACGGCTTTCT<br>AAGTATGCGAAGCAGGCAGAGACCCTCCAGGCAATACCCTACGACTTTCGGTTCTTCATG |
| 242 | 51 | ATGCTTCAACTGAACGGCTTTAGCATCGAAATCGCCGGAGGTTCCCTGACTGTCTTGAAATCTAAAATCGCG<br>CCTACCGACGTTAAAGAAACCCGCAGGAGCCTGGAAGACGACTGGTTCACCATGTATCACGAGGGCCACTTG<br>TACTCACTTGCAAAAAACAGCAACGCATCCGGCGGATTGGGTGAGACCGAGCTCCTGGTCCTGTCTGATCAT<br>CTGGGTCTTAGGTTCGTTAAGGCTATGTTGGACCAAGCCATGAGGGGCGTATTCGAGGCCTACGACCCCGTT<br>AGAGATAGGCCCTTCACATTTCTGGCGCGAAACGTAGATCTCGTAGCCCTCGCGGCAGAAACCTCGAGTCC<br>AAGCCCAGCCTTCTCTCCAAATTCGAGATCAGGCCCAAGTACGAACTGGAGGCCAAGGTAGTGGAATTCAGA<br>CCGGGCGAGCTGGAACTTATGCTGGCGCTCAATCTGACTACACGGTGGATCTGCAACGCCTCCGTAGACGAG<br>CTCATTGAGAAGAACATACCGGTCCGAGGAATGCACCTGATCCGACGGAACCGGGAGCCGGGACAGAGAAGC<br>TTGGTTGGCACCTTCGACCGCATGGAAGGCGACAACGCCCTGCTGCAGGATGCTTACGACGGACAAGACAAG<br>ATAGCAGCCTCACAGGTGAGGATCGAGGGGGACGCCAAGGAAGTCTTCGACGACCTCTCTGAGGAGGCTCTTGGGC<br>AATCGCTATACCAGTTTCATGCACTCCGTGGATAACGAGTACGGCAAGTTGTGCGGGGGTTTGGGGTTCGAC<br>GGCGAACTTAGGAAGATGCAGGGATTTCTCGCGAAAAAGAGTCCTATACAACTGCACGGAGGTGTAGAAGTG<br>TCCGTGGGGCAGAGGGTACAACTTACCAATCAGCCTGGGTATAAGACAACAGTTGAGCTTTTGCAGTCAAAG<br>TACTGCTTTGACAGAAGTAGGACGAAGCTCCACCCCTACGCCTGGGACGGGCTTGCTCGATTCGGCCCATTC<br>GACAGGGGCAGCTTCCCGACGCGATCCCCCAGGATTCTGCTCGTGACACCCGACTCCGCGAGCGGTAAGGTC<br>TCTCAAGCTCTGAAGAAATTCCGCGACGGGTTCGGCAGCAGCCAGAGCAGCATGTATGACGGCTTCCTCGAC<br>ACCTTTCACCTCAGTAATGCTCCTTTCTTCCCCCTTCCCGTGAAGCTGGACGGCGTGCAGCGCAGCGACGTG<br>GGCAAAGCTTATCGAAAGGCGATCGAAGATAAACTCGCACGAGACGACGACTTCGACGCCGCCTTTAACATT<br>CTCCTGGACGAGCACGCCAATCTGCCGGACAGCCATAACCCCTATCTGGTCGCCAAGTCCATCCTCCTCTCC<br>CACGGCATCCCAGTGCAAGAAGCACGAGTGAGCACTCTGACGGCCAACGAATACAGCCTGCAACACACCTTC<br>AGGAATGTCGCCACAGCCCTGTACGCCAAAATGGGTGGTGTCCCATGGACCGTTGACCACGGGGAGACCGTG<br>GACGATGAGCTGGTAGTAGGAATCGGAAACGCGGAGCTTAGCGGGAGCAGGTTCGAGAAAAGACAGAGGCAC<br>ATCGGAATCACGACAGTGTTTAGGGGGGACGGCAATACCTGCTTAGCAACCTCAGCAAGCAGAGTGCCGATAC<br>GAGGATTACCCGGACGTACTCCGGGAGAGTACCATCGCCGTGTTGAGGGAGGTTAAGCAAAGGAACAATTGG<br>TTGCCGGGTCAAACCGTGCGAATCGTTTTCCACGCCTTCAAGCCTCTGAAAAACGTGGAGATTGCCGACATC<br>ATCGCGAGCTCTGTAAAGGAGGTAGGCTCCGAACAGACCATAGAATTTGCATTCTTGAATGTTTCCCTCGAC<br>CACTCCTTCACCCTTCTGGACATGGCTCAAAGGGGAATAACGAAGAGAATCAGACCAAGGGGATATACGTT<br>CCCAGGAGGGGCATGACAGTCCAGGTTGGGCGCTACACCAGGCTTGTAACCAGCATCGGTCCGCACATGGTA<br>AAAAAGGGCAAACCTTGCCCTCCCGCGACCCCTGTTGATTCACCTGCACAAGCAGAGCACCTATCGGGACTG<br>AGCTATCTGAGCGAACAGGTTCTGAACTTTACCACCCTGTCCTGGAGGAGCACCCTCCCCAGCGAGAAGCCT<br>GTTACCATTCTCTACTCATCACTGATAGCCGACTTGTTGGGAAGGCTCAAGTCAGTGGATGATTGGAGCCCC<br>GCAGTGTTGAATACCAAACTGAGGAATAGCAAATGGTTCCTG |
| 243 | 28 | CTGGGAGCCGGTGCCAGCATCAGTTCCGGCATCCAAAGCGCTAATGACTGCATTTGGGACTGGAAGTACTCT<br>ATCTACCAAACTAACTCCGGCAGTCAACGAGTGGCCCTCGTGGACCCTAAGAAATCCGACGCCTCCAAGTCT<br>ATCATCCAGAAGTGGCTGGATAATCAACCGAAATTCTCACAGATCGAAGCCCATCAGGAGTACAGCTTCTAC<br>GCCCAGGCGGCTTACCCCATTGAGGCGGACCGAATCAAATACTTTCAGAATCTCTTCCAGGGGAAGTCCCCC<br>TATATCGGCTACAAATTGCTCTGCCTGCTGAACAAGTACGGTGTAGTGAAATCTGTGTGGAGTACCAACTTC<br>GACGGCCTGGTCGAACGGGCAGCACAGCAAGCCAACATCACCCTGATCGCCATCAATCTTGACTGTGTTGAC<br>CGCATATATCGAGCAGAAAGCGTGAATGAACTTCTGTATATCGCGCTCCACGGGGACTACAAGTTTAGTACC<br>ATAAAGAATACCGCGAATGAGCTCGACAGCCAGCACACCGAGTTCGTATCTGCCATGTGCCGGTACTTCGTC<br>GATAAAAACTTGATCGTCATGGGATACAGCGGACGCGACAAGTCACTTATGGACGCCCTGGTCCAAGCGTTT<br>AGCAGAAGGGTGGGGGGAGACTTTATTGGTGCGGCATGGGCGAGACCATCACGATCGAGGTGCAAAACCTG<br>ATACAGAGAGTGAGGACCGCAGGCCGGTCAGCTTATTATGTAGATACCTCTGGGTTTGACAACACCATGCTG<br>TCACTGGTAAAGTACTGTTTTTCAGAGGACGTCGCCAAACAGCGAGAAATAAACGAAATTTTGAAAATTGTG<br>GAACCGGAGCAGATTACTCCGTTTGAGATTCAAAAGAGCCAGAACAAACGGTATCTCAAGAGCAACCTGCTG<br>CCAATCGTGCTTCCCAAGGAACTCTTTCAGTTTCAGATCTCTTATAACGACACGGCGGACAGGTGGGGATTC<br>TTGCGCAGAGGATTAAGGAGCGGGAAATCATAGCAGTCCCGTACCAGGACAAAGTATACGCAATCAGCACG<br>GTCTCCATCATTAACGACGTTTTCAAGGACTGTCTCGTAAGCGAGATTGAGCGCACGTCCATCTCTCTGAAT<br>GAGATCGAGCGCAATGGCTGCTTCAAAGAGCTGTTCCTCAAGGCTATTCTCTACGGGTTTAGCCAAATCCGG<br>AATCTGGGCATCAACTACCGCCACGGCATCATTTGGAAGAAGGAGGCGCTCTACACTGAGCCCGGCAAGACC<br>GTACACGAGGCCATAGAATCCGGCTTGTCTTTTATACCGCAGCGAACTACGCTTTGATTAGCATCACACCA<br>AGTTTGCACATCGAATCCAGCAGCCCGATCGAAAAAGAGAAGAAACAAGAGTATAACAGGCGGTACCTTGAC<br>AAGATGAGGAATAAAGAGTACGAGGAAAAGATCCAGGAGTGGTGCAACATACTGTTCTCCGGTAACAAGCTC<br>GTTTTTGACATCCCGCTGCAAAGCAACAACGACTTGAAGTTCTTCATTTCCAGTAATAGGGGTTTCGCCGAG<br>GTATACAATTACGGTAAGGACATCGAGAAGAGCTACAGCCTCAATCCATTACAATACGAAACAGAACATTTAC<br>TACGGCATGCAAATCGAAGAGCCTCAGTTGGAGTTTATCAACTCCATAATCAGTAGGCCGTTCTATGACGTT<br>AACCCCAATGAGGGGCCTCTCAAATCACAAACCATTGACGCGGACTACTATGACAAGTTCCCCCAGGATGTG<br>TGTTTGGGCATTGTGTGTCCGACCAGCTACAGCCTGATGTTCTCAGAATTCCTGAAGCGCCTGAACACTAAG<br>ATCCCAGCACCGAAGTCATCCGACTACATCCACAACTATATTGGCTTTAACAGCATCTACAACTGCAGGCTG<br>GACATACCGGACATCAATGCCGATCGCTGGGTGAGCATCGGCGACAACCCCCAGAACGCGGAGGAATTGGCC |

TABLE 18-continued

Argonaute and helicase DNA sequences

| SEQ ID NO | Argonaute # | Sequence |
|---|---|---|
| | | CGCAACATCTGTATGGAAGCAAAAAAGCTGAGTGAACAATATCCGGGCATCGTGGTTAACATATTCATCCCT<br>ACTATCTGGAGCAACTACAGAAACTTTAAACACAACGGTGAATTCTTCGACCTGCATAACTACATTAAAGCA<br>TTTGCGGCACAAAATCGCTTCACCACGCAACTCATCGAGGAGAAAACTGTTTGTAACACGATGATGTGCGAG<br>ATATCCTGGTGGCTTTCCCTTGCCCTTTTCGTTAAGACCCTGAGGACTCCGTGGACACTGGCTGACCTTAAC<br>CCCAACACCGCCTACGCGGGGATAGGGTATTCAGTTAAAAAGCAGGCCAAGGGCAGGACAGAGATCGTACTG<br>GGGTGTAGCCACATTTACAATGCGCAGGGACAGGGACTCAAGTACAAACTGAGCAAGGTCGAGCACCCACAG<br>TTCGACAAAAAACGGAACCCATTCTTGAGCTTCGAGGAAGCCTTCAAATTCGGGATGGATATTCTTAATTTG<br>TTCCAGAGTGCAATGGAAAAACTGCCGCAGAGGGTGGTTATTCATAAACGGACGCCTTTTAGGGAAGAGGAA<br>ATAGAAGGGATTACCAGCGCCCTCAAGCGGGCAGGGATCACGGAGGTGGACCTGATCACTATAACGCAGGAG<br>CGAAACATTAAGTTTATAGCACAGGTTGTCTCCTTCGGCCAACTCAATACCGACGGCTATCCCGTCAACAGA<br>GGCACTTGCATCAAGCTTAGCTCTCGCAATGCACTCCTTTGGACCCACGGCGTCGTCCAGAGCATTCGAGAC<br>AAAAGACGGTACTACCAGGGGGGCAGGTGCATTCCGAGCCCGCTGAAAATCACTAAGTATTACGGCAACGGC<br>GATCTCCAGACTATAGCTAAGGAGATCATCGGTTTCACGAAGATGAATTGGAATAGCTTCAACTTCTATACG<br>AAGCTGCCAGCGACCATTGACACTAGCAACACCCTGGCCCAAGTGGGCAACCTTCTCAGGAACTATAATGGC<br>ACCACCTACGATTATCGCTACTTTATC |
| 244 | 43 | ATGGCCAACCATACCTTTAACATCCTGACTTTCAACCACCCCCAGGAGGAACAGACCTTCTACTTCACGGAC<br>CAGGAGCAAGACAACCTGACCCGCATCTACAAGAGCCTGGTGCCCGACGAGGTCATCGAGAAATATGGCGAG<br>CAGGATCACTACTACACCTCTTTCACCGTAGAGAAGGATGGTTTCCTGGCCGTCAGCAAGCCCACAACGCCC<br>CTGTTCGAGACCAAGACTACGGAGGCGGGCGAGGAGGAGCTATACCATCAGGAATTCAACGTTCAGCAGC<br>AGCGTGTTGAAACGGTACTACAACAGCCTTATCCACAGCCACTTCAAGGAGAAGGGCTTCCTGGTGAAGCCC<br>AACTTCGTGAGCGACACGGAGGTGTGGCTGCCTAGCGCCAAGCAGGACACGACCGGCAAATACAAAATATTC<br>GACCGCTTTAGCCTGAAGGTGCAGTTCAAGACCGTCTCTGATTCCCTGGAGTTGCTCGTCACGTTCGAGGGG<br>AAGTCAAAGATATTCAAAGTACCTGTTAGCACCCTGCTGGAGGATGTGAGCCCCACGGACATCAACTGGGTT<br>GTGTACGAAAAGGGGATTGTACAGGTTCGACGAACTCCCGGACAGCGGCAAGAGGGAGTATGACAAGGTTTAC<br>CCCGTGTGGACCTCGAGATCAGGGACGCGCTTATGCAGGGCACCGAAGCCCCAGACAAGACCAACAAGTAC<br>AAAAAGTTCAGGGAGGGCATCGACAAGTTCTATAACCAGTATCTGAACACAGAGGAGTTCAAAGCCATCATT<br>CCAATCACGTCTAATGGCTTCATCCCGGTCATTAAGATCAATGTCGGTAGTGTGAATAATAGTAGCAACAGG<br>CTGCTGTTCGGGGAACAAAAGAGCGGTATCGTGCCAATGGACGGCATGAAGGAACATGGCCCATTCGACTTT<br>TCCAGCACCAGCAAGATCCATTTCTTCTTTATCTTTCATAAAGACGACCAGCACATCGCCCAAAAGATGGAT<br>GGCTATTTCAAAGGCAGCGAGTTCGGGTTCAAGGGACTCACCAAATTCATACACACCCCCTATCACACCGAG<br>AAAGGATTCTCAATCAGGTTTGAGGACCGCGCGACAATCCGTGGCCCGAGATCTACGAAGCCGTCACTAACAAG<br>CACTTCGAGTCCGACATACAATACATTGCGATCTACATCAGCCCCTTCAGCAAAAACAGCCCCGACAAGAGT<br>CGGCGCAAAATCTATTACAAGCTCAAAGAACTGCTCTTGAAAGAAGGCGTGAGCAGCCAGGTGATTGACGGC<br>GAGAAGGTGATGACCAACGAGAAGTATTACTACAGCCTCCCCAACATAGCAATCGCCATTCTGGCCAAGTTG<br>AATGGCACCCCTTGGAAACTGGACACCAAGCTGAAGAACGAACTGATCGTGGGAATCGGCGCCTTCCGCAAC<br>AGCGAGGTTGACATTCAATATATCGGCAGCGCGTTCTCTTTCGCAAACAACGGCAAGTTTAATCGCTTTGAG<br>TGCTTCCAGAAGGACCAGACGAAAGAATTGGCGGGAAGCATCATACGGGCGGTGAAGGAGTACGCCAACGTA<br>AACACCGGCATTAAGAGGCTTGTGATCCACTTTTACAAAAGCATGCGACAGGATGAGCTCCAGCCGATCGAG<br>GACGGCCTTAAAGACCTCGGCCTGGACATTCCGGTATTCATCGTATCTATCAATAAAACAGAAAGCAGTGAT<br>ATCGTGGCGTTCGATAACAGCTGGAAGGATCTGATGCCGATGAGCGGCCACATTCATTAAAGTGGGGTACAAC<br>AAATTTCTCCTGTTCAACAACACCAGGTATAATCCAAAGTTTTACAGCTTCCACGACGGGTTCCCCTTCCCC<br>ATCAAACTTAAGATTTTTTGCACTGAAAAGGAACTCGTGGAGGAGTATAAAACGGTTAAAGAGCTGATCGAC<br>CAGGTGTACCAATTTAGCCGCATGTACTGGAAGTCTGTCCGCCAGCAGAACCTGCCCGTGACCATTAAGTAT<br>CCGGAAATGGTGGCCGAAATGTTGCCTCACTTTGACGGGAATGAGATACCTGAATTCGGTAAGGACAACTTG<br>TGGTTCCTG |
| 245 | 74 | GTGAACCATTACTATTTTTCCGAATGCAAGGCGGACGAGAAAGCCAGCGACATAGCCATCCACCTTTACACC<br>GTGCCCCTGTCCAACCCCATGAGAAATACAGCTATGCGCACAGCATCGCCTATGAATTGAGAAAACTCAAC<br>TCATACATAACCGTGGCCGCGCACGGTCAGTACATCGCGTCTTTCGAGGAGATATGCCACTGGGGCGACCAC<br>AGGTACATACAGCACGAACATAGACCAATCCAGTGCAGCCTCCCGATGGAGAGGACCATACTGGAAAGACTC<br>CTCAAGAAAGAGCTCGAGAATAGGTGCAAAAGCAGCTATAAGATGGACAACGACCTTTTCCGGTTGGCTAAC<br>GAGCAAAGCATGCACGTGGGCGAGATCAGCATACACCCAGCGATCTACATCTCATTCAGCGTGGAGGAAAAT<br>GGTGACATATTTGTTGGCTTCGACTACCAGCACCGGTTCGAGTACCGCAAAACACTCCAAGACGTCATCAAC<br>AACGATCCCTCCCTGCTTAAGGAAGGCATGGAAGTGGTGGACCCCTTCAATAGAAGGGCCTACTATTACACT<br>TTTGTGGGCATGGCCGATTATACCGCCGGACAGAAAAGCCCCTTCCTGCAGCAGTCTGTGATCGACTATTAT<br>CTCGAAAAGAATGAGCTGTGGAAGCTCAAGGGTGTGCACGAAAAAACCCCCGTGGTGCACGTCAAGAGCCGA<br>GACGGTCACTTGCTCCCGTATCTGCCGCACCTGCTCAAATTGACATGTTCATACGAACAGCTCTTGCCCAGC<br>ATGACCAAGGAAGTCAATCGCCTGATTAAGCTGAGCCCCAACGAGAAGATGAGTAAGTTGTATACGGAGATG<br>TTTCGATTGCTCCGGCAGCAACAGGTGCTGACCTTCAAGAAGGAAACGTGCGAGCCGTCAACCTCGGCTAC<br>GATGTGAATGAACTTGACAGCCCGATCATGGAGTTCGGACAAGGCTACAAGACAAACGAGATCTATCGAGGC<br>CTGAAGCAGAGCGGAGTATACGAGCCCAGCTCAGTGGCCGTGAGCTTTTTTGTTGACCCCGAGCTTAACTAC<br>GACCCCCAGAAGCGGAAAGAAGTAGGTTGCTTCGTCAAAAAACTGGAGAGCATGAGCGAGGCCCTGGGAGTA<br>AAACTGAACATAAGCGACCAGCCCCGACAACTTTATGGCCAGCTCCCAAGGACTTTTTCAAGCAGGACAAC<br>CTCTCATATCATTTGAAATCTATCACCGACCAGTTCAGGGGAACGGTGGTGGTTGTTATCGGCACTGAAGAG<br>AACATCGACCGGGCATACGTTACAATCAAAAAGGAATTCGGCGGCAAGGAGGATCTGATGACCCAGTTTGTC<br>GGCTTCACCTCCTCCCTCGTCACGGAGAACAACATTTTTCACTACTACAACATCCTGCTCGGCATCTATGCG<br>AAAGCTGGTGTTCAGCCCTGGATACTCGCCAGCCCAATGCACTCAGACTGTTTCATTGGACTCGACGTAAGC<br>CACGAGCACGGTAAGCACGCATCAGGGATAATACAAGTGATTGGACGGGACGGCAAGATTATCAAACAAAAG<br>AGCGTTGCAGACAGAGGCCGGAGAGACTATTGCCAATAGCACGAGGAAGAAATCGTCAACGAAAGCATT<br>TATTCCTACGAGCAGATCTACGGGGCCAAACCGCGCCACATAACATTCCATAGAGACGGGATCTGTCGCGAG<br>GACCTCGATTTTCTGCAAGCGTATTTGCGGAGTTTCCAAATCCCATTCGACTTCGTAGAAATCATAAAGAAG<br>CCGCGACGCAGAATGGCGATATACTCTAATAAGAAGTGGGTCACGAAACAGGGAATATACTACAGTAAGGGC<br>AACACCGCTTATCTGTGTGCCACGGACCCCAGAGAATCCGTGGGTATGGCGCAACTTGTCAAGATCGTACAG<br>AAGACTAACGGATTGAGCGTTCACGAGATAGTGAGCGACGTGTATAAGCTGTCCTTCATGCACATACACAGT |

TABLE 18-continued

Argonaute and helicase DNA sequences

| SEQ ID NO | Argonaute # | Sequence |
|---|---|---|
| | | ATGCTCAAGACCAGGTTGCCTATCACGATACACTATAGCGACCTCAGCTCAACGTTCCACAACCGGGGCTTG<br>ATCCATCCCCGGTCCCAACATGAGAGAGCACTCCCGTTCGTG |
| 246 | 68 | ATGGAGAACCTGGCTCTTAGTGCGCTGCAACTGGACTCTAAGCTCGACCGCTACATCGTGTGCAGGTACAGA<br>ATCGTGTACCAGAAGCGAGACGAGACCATTCCCGGCGAACAGTTGGCCCGGAAGGCGGCCTACGAGATCCAG<br>AAAGCGAATGACTTCGCCCTTTTGACCAACCTCGGCAATCAACACATCGTTTCCCTCAAGCCCATCTCACAG<br>AGGGGCATTGAAAGCACCCACCTTCAGGCGAATCTCATCGAAGACGGGGACCTGGAGCTCGATTGCTCCATC<br>GAACAACATCAGCAGGCACTCCAGCGGCTCGTGAACCAGGACATCAATAAAGCTGCGTGGGAAGCTTAAGAAG<br>AGCTCACAGGGCAAACTCGATTACAAAAAGGCAGCTAGCGGGAACACCGAGATCTTTGAGCCAATTCATAGC<br>ACTCGAATCAACGCCCGAGCCACGTATCTTGACGCTTTTTGCTCACTGCAGCTTAGCCCCGAGGTGCTTGCT<br>AATGGAACCGTACTGATAGGGCTGCATCTCAAGCACAATCTGGTAGCAAAGTCTGACATCTCTTTGCAGTGG<br>ATCATTGATAAAAGGCCCGATTGGCTGCAGAGCATCAAGAAGGTGCGGCACAGGTACTTCGATCCCGGCAAA<br>GCGCCCCTGGTCGCCGAATTCCTGAGGGTGGAGGACTCCCTGAATGGCAACAGCGTCTTGCCCCACATGGGC<br>CAGAGTCTTGTTTCATACCACCAAGCGAAGGGACTCTTGTCAGAAAGACAGCTCGCAGAGGCCACGAAGAGC<br>GTGCTGATAAAGGTAAAATACGGCAAAAACGAGGCGGACCACATCGCATCTCTGGTTGAACCAATGTTTGAT<br>TTCGACACGCTCAGCAAGATCGATAGTATCTTCCTTAACAAGTTGGCAAAGGACCTGAAGTGGAGCCTGAAC<br>GACAGGATACGCACTTCCGCGAAAATGGTGAAAGGCTTGTATCTCCCAAACTTCAACTGCAAGCTGGAACAG<br>GTTGACTATCAGATCCTTCACAGGCAGCGACTTAATCACCAACAGATGCTTCAATTCGCCAACGGGGCGAAA<br>TCTTCAAGAGAGCAGGACGTGCTGCGACATAAGGCGTTCGGCAACATGACGCGCACACAAGTTATCCCGCTT<br>ATTGCGGGCGAGAAGAACAATACAGAACAAAATAAGCAGCTCCTGTGCAACGCATACCAAGCATTGCAACAA<br>CTGACCACCACGGAATTGCCTCCGTTCACCAAGTTCCCCAACCCCGTAGAGAACGCAGCCGAGCTGGACGCA<br>AGACTGAATGAACGGTGTCCCCAAATGCGATACTGCTCATCGGCCTTATCGACAAAAGCGACAAAGTGGCG<br>ATCCGCGACACCGCGTTTAGCTACGGTCTTGCAACCCAGTTCATGCGCCTGGATACAGACCGAACGTCTAC<br>AGCCCCTCATATTTCAACAACGTGGCGGCTGGTTTGTTTTCCAAAGGTGGCGGGCAGCTCTGCGCCATTGAT<br>GACATGCCGGGTGAAACCGACTTGTTTATCGGTCTCGACATGGGAGGGATCTCTGTAAGGGCACCAGGCTTC<br>GCGTTTCTGTTTCTGCGATCTGGTGCGCAGTTGGGGTGGCAACTCGCGGACAAACAACAGGGAGAAGGATG<br>CAGGATGAGGCCCTGATGTCACTGTTGGACAAGTCTCTCACCACCTACCTGAGAAGCTGCTCTGGTGAGCTT<br>CCTAAGCGCATAACCCTCCATAGGGATGGCAAGTTCTACGAAAGCATAGAAGTGATCGAGCAGTTTGAGCAG<br>AAGCACGGCGTGAAAGTAGATGTGCTGGAGGTTCTGAAAAGCGGTGCTCCGGTTTTGTATAGACGAAGCCGC<br>ATGGCCGACGGAACCAAGGAGTTTAGCAACCCCAATGTGGGCGACGCGATCTATCTCAGTGATCATGAGATG<br>ATCCTGAGCACGTATAGCGGCGAAGAACTCGGAAAGATATGGGGTGACAAGGTCAGCGTCAGGCCTCTTAGG<br>CTGCGCAAGAGATACGGTGATGTGAGCCTGGAGACCCTGGCACATCAAGTGCTCGTGCTGTCTAGGATACAC<br>GGCGCTAGCCTGTATCGCCATCCTCGACTGCCCGTGACCACGCACCACGCCGACCGATTCGCAACACTGAGG<br>CAGGAAACATGCATAGACGCCCTCTCTAAGATGGACCGGCTCTGTCCGGTCTACCTG |
| 247 | 56 | ATGCAGCTGAACTACTTCCCCATAAAGTTTGAGTTTGAAGAGTACCAGATAAAAACTGAGCCCTACAGCGAA<br>GAACGACTTAAAGAGTTGAGGGCCAGTTACAACGCCACCCACTCCTTCTTTTTTAGAAATGGAGACAATATATGT<br>ATTAGCAACAAGGAAGGCGAGGACATTAGTCTGACCGGCGAGGTGATACCGAAAAGAATTTTCGACGACAGT<br>CAAGTGACCGCCTCATTGATAAAGCACTTGTTTTTCAGGACGTTCAAGGAGAGGTTCCCCAACTATATTCCT<br>GTGGACTTTTACCCCTTCCGCTTCTTCTCCGCCCAGGCTAAAGACGACATCATCTATAACGCCCTGCCCGGC<br>AACCTCCGGAAACGAATCGCTTACAAAAAGCTGATCGAGGTTCAGTTGCGGCTGACGGAAATAAACGGCATC<br>AAGCAGTTTGGCTTCCTGATCAACATTAAACGAAATTGGGTGTTCAACAAGTCATGCTTCGAGCTCCACTCC<br>GAGGGCTACAACCTGATCGGGGTGGACGTGCTGTACGCCGAGGAACTGCCGGGGTTGACGAGGTGCTGGCC<br>CCAAACGAAGAGCTTTTGGGCGTAATCGCGGAAATCGTGGACGACAATGCCAGGATAGAAACCAACGAGGGC<br>ATTAAGGAGTTCCCTCTGAACCAGTTGTTCATCAAGAAAAGCAAGTACAACATTGGCAATTACCTTAGCTTG<br>GCGATCTCTCAGCAAAAGAGCGACGAAATAATGAATCTTATCGAGAGCAAACGCTCCGACATCTACAATACC<br>AAGGGTCTTTACGACGAGATCTTGAAAATTGCGAACCATCTTTTTTGCGAGAACAGCGCACCCATACTGTTT<br>CATAATAAGGACGGATTCTGCTTTACTGTCGATTCCCAGCCGCTCAGTGTGACGAACAGCATGGAATTGAAG<br>ACTCCAACATTCATATACGATCCAGCGGCCACGAAGACGAATTCTAGCAATCCCGACTTGGGCCTGTCCAAT<br>TACGGGCCCTACGACTCCAGCATTTTTGACATAAAGATACCCAACGTGTTGTGCATCTGCAATAGGAATAAT<br>CGAGGCAACTTTACAAAGTTTCTGTCTAACCTGAAAGACGGGATACCTCAAAGCCGCTATTTCAGAAAGGC<br>CTCCAGAAGAAATACGACCTCCAGGATGTGATCCTCAATATCCGAGAAATCCAGGCCTATAGCATCGCCGAC<br>TACCTTAACGCCATCAGGGACTACGATGAGAACAAGCCTCATCTGGCGATCATCGAGATCCCTGCCAGCTTC<br>AAGAGGCAGGCCGACGTGGCGAACCCCTACTACCAAATTAAGGCCAAGTTGTTGAGCCTGGAGATTCCCGTG<br>CAATTCGTTACCAGCGAGACCATCGGTAACCACAACGAGTATATCCTGAACTCTATCGCGCTGCAGATCTAC<br>GCAAAGCTCGGCGGGACCCCGTGGGTCCTGCCCTCTCAACGCAGCGTTGACAAAGAGATAATCATCGGAATA<br>GGCCATTCCTGGCTTAGGCGCAACCAGTACGCTGGCGCAGAACAGAATAGGGTAGTGGGGATCACGACCTTT<br>ATGAGCTCCGATGGCCAGTACCTTCTGGGTGACAAGGTCAAAGATGTTGCCTTCGAGAACTATTTTGAGGAG<br>CTTCTGAAAAGCCTGAAGCAAAGCATCCAGAGGCTCAGCACAGAGCAGGGCTGGAGCGATGGCGACACCGTG<br>AGGCTGATATTCCACATATTCAAACCGATAAAGAACACTGAATTCGACGTGATCAGTCAGCTTGTCAGAGAC<br>ATCACGCAGTACAAGATTAAGTTCGCATTCGTAACCATCAGCACTGTGCACCCTTCCATGTTGTTGACATT<br>AATCAGTCCGGTATCGCCAAATACGGTTCCAATATCATGAAGGGACAATACATACCAACAAGGGCAGCAAC<br>GTTTTCCTGGACGAGAAGACATGCATCGTACAGATGTTCGGCGCGAACGAACTGAAAACGGCCAAGCAAGGC<br>ATGAGCAAGCCCATCCTTATAAACATTCGCACCCCCCAGGGGAACTACAATTCAAGCGACCTGAACGATCTC<br>CTGTTTTATGACCTGGGGTACATCACACAACAGATATTTAGCTTTACCTACCTCAGCTGGCGGTCCTTCTTG<br>CCCGGTGAAGAGCCGGCGACTATGAAGTACAGTAACCTTCATTTCCAAACTTCTCGGGAAGATGCGGAACATC<br>CCTAACTGGGACGCCGACAATCTTAACTACGGCCTGAAACGGAAAAAGTGGTTCCTG |
| 248 | 4 | CTGAAGCTGAACCACTTCCCCCTTAATCCCGACCTCCCCCTGTACATCACAGAATATGCCCACCGGAACCCG<br>CGAGCGTTGCTCGGATTCGTTAGGGGCCAAGGTTTCTGGCGCAACAGGTCGGAGAACAGGTACAAGTGTAC<br>CACGGTAGACCGCAGCCCACGTTCAGGGGAGTTCAGGTGATCAGCCATACCAGGTTGGACCCCGACCATCCG<br>GCTTTTTGACCAAGGCGTTTTGAGCCTCATCCGACAAGCACTGGTGAGGGCGGGATACGTGCTGACCTACAGG<br>GAGAGGATGGCTATTCATCCCAGACTGGAGAGGGTTGTGCTGAGACCCCCGGACCGGCACCCAGCAGAGTTG<br>ACCGTCCATGCACATCTGCGATGGGAATGGGAGCTTGAAAGGCACAGCGGACAACGCTGGCTGGTTCTTCGA<br>CCCGGCAGGCGACATCTGAGCGCCCTTCCATGGCCCGCAGAAGCAGTACAAATGTGGTCCGCCGCTCTTCCG |

TABLE 18-continued

Argonaute and helicase DNA sequences

| SEQ ID NO | Argonaute # | Sequence |
|---|---|---|
| | | GCCACCTGCCAGAAGCTGCACGCCCTTTGTCTGGACCGAGGCCAACAGATGGCCCTTTTGCGGCAAGAGGAC<br>GGCTGGCACTTCGCCAATCCCGGTGCTGCCACTCAAGGAAGGTGGCACCTGTCCTTTAGCCCCCAGGCCCTT<br>CACGAGCTGGGACTGGCACAGGCTGCGCACCATGCGGCTGCATTTAGGTGGGACGAGGTACAGCGACTCGTG<br>CAACTGACTGACCTGTGGAAGCCCTTCGTGACCTCTCTGGAGCCCCTTGAGGTAGCTGCCCCCATCATTGCC<br>GGGAAAAGGCTGAGGTTTGGACGGGGTCTTGGCCGCGATGTCACGGAGGTGCACAAGCGAGGTATCCTGGAA<br>CCACCCCCACTGCCCGTGCGACTGGCTGTCGTGTCTCCCCATCTTCCTGATGAGCACGCGAACGCCCAGTTG<br>AGGCGGGAGTTGCTTGCTCACCTCCTCCCGCGACACCAAGTACTGAGATCAGCGGAGAGCCGGCAAGGCCTC<br>CACGAGCACCTGAGGAGGCAAGATCAGGACGATACCCTGTATACCTTTTGGTCAGGCGGCGAGTACAGGAAG<br>CTGGGCTTGCCCCCCTTCGATCTCGCACGAGGCCTGCACACCTACGACCCAGCTAGCGGCCAGCTGCAACAA<br>CCGGCTGCCCTGGCACCAGCACCCGCGCAGGCCACGCAAGCGGGTAGGCAGCTGATAGCCCTGGTGGTGTTG<br>CCCGACGACCTGACGCGGTCTGTCCGGGACACCCTGTTTCAGCAGCTCCAGCAGTTGGGCCTTAGGTGTCTG<br>TTTAGTGTGAGCAGGACCCTGCTGCACCGACCACGCACAGAGTATATGGCATGGGTAAACATGGCCGTCAAG<br>TTGGCTAGGACTGCAGGGGCCGTGCCTTGGGACCTGGCAGACCTGCCCGGTGTCACCGAGCAGACGTTTTTC<br>GTAGGCGTTGATCTGGGGCATGACCACACCCACCAACAGTCCCTCCCGGCCTTCACCCTGCACGACCATAGG<br>GGACGCCCTCTTCAAAGCTGGACGCCTCCCCGACGCACCAATAATGAGAGGCTGTCATTGGCCGAGCTTAAG<br>AAGGGGTTGCATAGGCTTCTTGCACGCAGGAGCGTGGACCAAGTGATCGTGCATCGAGACGGCCGATTCCTT<br>GCTGGCGAGGTGGACGACTTCACTCTGGCGTTGCATGATCTCGGCATCCCGCAGTTTAGCTTGTTGGCAATC<br>AAAAAAAGCAACCACAGCGTGGCGGTGCAAGCAGAGGAAGGATCCGTGCTTAGCCTGGACGAACGACGATGC<br>CTTCTTGTTACTAATACCCAAGCCGCGCTTCCGCGGCCCACGGAGTTGGAACTGGTCCATAGCGACAGGCTT<br>AGTTTGGCGACCCTGACCGAACAAGTATTCTGGCTGACCCGCTGTCTTCATGAACAACGCGCAGCATGCGGGC<br>AGCGATCCAGCCACCATCGAATGGGCCAACGGCATAGCCAGGACTGGACAGCGAGTGCCCCTGGCCGGGTGG<br>CGGCTG |
| 249 | 27 | ATGCCCACCCAGTTCCAGGAGGTGGAAGTGATACTCAACCGCTTCTTTGTAAAGAAACTGTCTCGGCCCGAC<br>CTTACGTTCCATGAGTACCAATGCCAGTTCACCCAGGTTCCAGAGCAAGGCAGCGAACAAAAGGCCATCAGC<br>AGCGTGTGCTACAAGCTCGGTGTGACCGCCGTGAGGCTGGGCTCATGCATCATCACCAGGGAGCCCATAGAC<br>CCTGAAAGGATGCGCACCAAAGATTGGCAGTTGCAGCTGATCGGATGCCGAGAGCTGAGCTGCCAAAACTAC<br>CGAGAGAGGCAAGCTTTGGAGACTTTCGAGCGAAAAATCCTGGCAGGAAAAGCTCAAGGAAACATTTAAGAAG<br>ACCATCATCGAGAAGGACTACGAGTTGGGCCTGATCTGGTGGATATCAGGCGAAGAGGGACTGGAAAAAACC<br>GGTCACGGGTGGGAAGTGCACAGGGGCAGGCAAATAGACCTCAAGATCGAGACGGACGAAAAGTTGTACCTG<br>GAGATCGACATACATCACAGGTTCTACACCCCCTTCAAGCTGGAGTGGTGGCTGAGCGAATACCCCAACATC<br>CAAATCAAGTACGTGCGCAACACGTACAAGGACAAGAAGAAATGGATACTGGAGAATTTCGCCGACAAGAGC<br>CCCAACGAGATTCAGATAGAGGCCCTTGGCATCAGCCTTGCGGAATACCACCGGCAAGAAGGTGCTACCCAG<br>CAGGAAATCGACGAGAGTAGGGTTGTGATCGTCAAAAAGATCTCTGACTACAAGGCGAAACCCGTGTATCAC<br>CTGTCTCAGAGGCTGTCCCCGATACTGACCATGGAGACCCTTGCCCAGATCGCCGAGCAGGGTCGGGAAAAG<br>AAGGAGATACAGGGCGTGTTCGATTACATTAGGAAGAACATCGGCACGAGGCTGCAGGAGAGCCAGAAGATC<br>GCGCAGGTCATTTTCAAGAATGTTTATAACCTTAGCAGCCAGCCCGAGATCATGAAGGTGAACGGTTTTGTA<br>ATGCCACGCGCGAAGTTGTTGGCAAGGAACAATAAGGAGGTCAACCAGACCGCTAGGATCAAGAGTTTCGGC<br>TGCGCTAAGATCGGAGAAACGAAGTTCGGATGTCTCAATCTGTTCGACAACAAACCGGAGTACCCGGAGGAG<br>GTACACAAGTGCTTGCTGGCGATTGCGCGGAGCAGTGGGGTCCAGATAAAGATAGATAGCTACTTCACGGGG<br>AGCGACTACCCGAAAGATGACTTGGCCCAGCAAAGGTTCTGGCAACAGTGGGCGGCACAAGGAATAAAGACG<br>GTGCTGGTCGTGATGCCCTGGTCCCCTCACGAGGAGAAGACAAGACTGCGGATCCAAGCTCTTAAAGCCGGC<br>ATCGCAACTCAATTTATGATCCCCACGCCCCAGGATAACCCATACAAAGCATTGAACGTTGCTTTGGGTCTG<br>CTCTGCAAAGCCAAATGGCAACCCGTTTACCTGAAGCCCCTGGATGACCCCAGGCCGCAGACCTGATCATC<br>GGCTTCGACACTTCTACCAACAGGCGGCTCTACTACGGTACAAGCGCCTTCGCGATTCTGGCGAACGGCCAG<br>TCACTGGGCTGGGAGTTGCCTGACATCCAGAGGGGCGAGACATTTAGCGGCCAAAGTATATGGCAGGTAGTG<br>AGCAAACTTGTGCTGAAATTCCAAGACAACTACGACAGCTACCCTAAGAAAATTCTGCTTATGAGGGATGGA<br>CTGGTTCAAGACGGCGAGTTTGAACAGACCATAAGAGAGTTGACCCACCAAGGGATCGACGTGGACATCCTG<br>AGCGTGAGGAAGAGCGGTAGTGGCAGGATGGGAAGAGAACTGACAAGCGGCAATACTGCCATCACCTATGAC<br>GACGCCGAAGTGGGAACCGTGATATTCTATTCTGCCACCGACTCATTCATACTGCAGACAACCGAGGTAATT<br>AAGACAAAAACGGGCCCACTCGGTTCCGCGCGACCGCTCAGAGTGGTTAGGCACTACGGGAACACCCCGCTT<br>GAACTGCTCGCGCTGCAAACGTACCACCTGACCCAATTGCATCCCGCCAGCGGCTTTCGGAGCTGTAGGCTC<br>CCCTGGGTTCTGCACTTGGCAGACAGGAGCAGCAAGGAGTTCCAACGGATCGGTCAAATTTCATTGCTCCAG<br>AACGTGGATAGGGAGAAGCTGATTGCAGTG |
| 250 | 24 | ATGCTCACACAAGAACAATTTATACGCAACTTTAGCGTTATGGCCAATGGTGAAGTAGACTTCTTTCTTGGT<br>GCCGGTGCATCTATTGCGAGTGGAATCCCAACTGGGGGTGGCTTGATTTGGGAATTTAAGAGGACACTGTAC<br>TGTAGCGAGTGCGGCATCAGCGCCGAAAAGTACAAGGACCTGTCACTCGTCACGACCGCGAAACGCTCCAG<br>GACTACTTCGACATTAAAGGGTATTGCCCCAAACAATATGCGCCTGAGGAATACAGCTTCTATTTCGAGCAA<br>TGTTACACCGATCCCATGGCCCGAAAGAGGTTCATCGAGAATATGGTTAGTGGGAGGGAGCCAAGTATAGGT<br>TACCTTTGTCTCGCGGAGGCCGTTATGCAAGGCAAAGTTAAAAACATTTGGACTACCAACTTCGATAGCCTT<br>CTGGAGAATGCCCTCCATAGGCTTTACCCCATGAACAACGTTTTGGTGTGCTCCGAGGCTAATAGAGGCAGT<br>GTGTGCCTGCTCAACCCGACGTACCCAGTCATAGGCAAGTTCCACGGCGACTATCGCTATGATTGGCTCAGG<br>AACACCGAGGACGAATTGCAGCGACTCGAGACCAGCCTTAAAGGTTACGCGTCCAGCCAACTTACAGGGAAA<br>CAACTCGTCGTTATAGGATATAGCGGGAACGATGAGAGCATTATCAGTTTCCTCAAGGATTGCATAGATAAC<br>CCGGCACTGCTTACCAAGGGTCTGCTGTGGGCTGTACGACGCGGTTCCTGGGTAAACCCGAGGGTTAATGAG<br>CTGATAGAACGGGCGCACAAAATTGGGAAACCAGCCGACGTGATCGAGATCGATGGCTTCGACCAATTGATG<br>TTCTCAATATACCAGATCCAGAACTACCATAATGAGATTATCGACGGCAAGGCAGGCTCCTCCAGGTCGGA<br>TCTGACATCCGCCTCACGGGGAAGCCCGTGGACAGCTTTGTCAAGCTGAACGCTTACAAGGCTGAGTACTGC<br>CCCCTTTGTAACGTGTTCAACAGACATCACATCCTGGAAGGAACTTCGGACCATAACCCTGGCAGCAGTGAC<br>ATCATCGCCGGTCTGTTCTCCAAACATATCTATTCTCTGTCTTCCGCAGACAAATTGAAGACCGTGTTCAGC<br>AAGCACTTTCTCTAGCATTAACAAGGAGGAGGCTCCCGAACGGGACATTCGACGGAACGAGAGTGTGTAC<br>ATTGGATTGATTTACCAGCTTATTAAGCGGACCCTGCTTTCAAAAGGGATGGTGTCCTTCGCTAAGAATAAG<br>GTCTATAACCCCGACAGCTGCCGCAGCGAGCAAGGCTACCAAGTTTTTGACGCCCTGGAGATCGCGGTCAGC<br>TTCGTTGATGGAAACCTGTACCTGAATCTTATGCCCACGGTACATGTGAGAGGCTCAAATGGCGAGAGTCTC |

TABLE 18-continued

Argonaute and helicase DNA sequences

| SEQ ID NO | Argonaute # | Sequence |
|---|---|---|
| | | GACAAAGAGTCCTACCAAATACAAGTCAACCATGTGGTCAGCACAATCTACAATAAGCAATACAATGAGAAA<br>CTGCGGTTCTGGGAGAGCTTGTGTCTGGACAGTGGTAGAATAATCTTCGAGAACGACGGCTTCAGCATATCA<br>TTTGTCGCTCCCGCTGTCTCCCTGGGCGGCAACAATCGAAGAGCTAAGTGGCTTTCCATGCCGTCCTGCAAG<br>TATGACGAACCACTCATGTGCTTCTCAGACACTGACAAAAGCAAACGAGTTATTAACCAACTGAAGGGACTC<br>TGCCAGTACGGGCCAATCGACTGCTCTTATATGCGGGATAGCACCACAAGGCCCAGCGTTAGGCTGGCCGTT<br>CTGAGCCCGAACCAGGACATGGACCGAATTCTTGCACACCTCAATAAACTCAACACCCACGTCCAAACAGG<br>GGCAGCGATAATTTCCTGCCCCACTATGAGGGCTTTGAGCAAGTTTACAGAAGGGCTCTGAGCGTCCCTACG<br>AAGGAGCAGAGCAACATCTGCATCGGATACAACGTGAACGCCATCCTCAAAATGTCTCCTGCAGAGTTTCTG<br>GCTTTTATGAAGCGGGGTATAGAGAAATACTCCCTTCGGTCAAGCGATTTCGATATACTCGTTATTTACATC<br>CCAGAGTCATTCGCGCATTTCCGGACAGCAACCGAATTAGTAGCGACTACAATCTGCACGATGCGCTCAAA<br>CTGTATGCCACGGATAAGGGGATTATCCTTCAACTCATAGAGGAGAAATCTGTGAAGTCATACGACCCCTGC<br>AAAGTAATGTGGGGCTTGTCCACCTCACTCTACGCGAAGGCGACAGGGGTACTTTGGCATCCAGAGGCAATT<br>AGAAATGACACGGCCTACATAGGGATAAGCTACGCTTTCAGCGAAGAGAAAAGGATTTGTATAGGCTGCAGT<br>CAGCTGTTCGACTCAACCGGGACAGGTATTCGGATGGTCCTTAGAAAGATAAACAATCCGATATTTCTGGGG<br>CGATCCAACCCCTACATGAGGGAAGACGACGCTCGAATTATGATGACCGAGCTCAGGGAGCAGTATTACCAC<br>AGCGCACCTGTGAATACTCTCAAGAGGGTCGTGATCCATAAGACCACGCCCTTCATCACGGGATGAGATAGCC<br>GGTATAATGCAGGCATTTAACGGCATCGAGGTCGAGCTGGTTCAGATTCAAGACTATTGCTCTTGGAGAGGC<br>ATACGCTTCGGCGGTGAGCCTGGGAAAACGGCGTTTGGGTTCCCGGTGAAGCGAGGTATGGCCGTAAAACTC<br>GACCGAGAAAGCTTCCTGCTCTGGACCCACGGCTGCGTGATTCACCCGGAACTGTCAGGCACGCATAACTAT<br>TTCAAAGGTTCACGCGGTATCCCAGCACCCCTCCTGGTCCGCAGGTTTGCGGGTAACGCAAGTGGCGACACA<br>TTGGCAAAAGAGATTCTGATGCTTACGAAGATGAACTGGAACTCCGGTGACAGTCTGTACAAAACCCTTCCC<br>GTGACCCTGGATTTTGCGAAAGTTCTCGCCCGCATGTCTAAGCAAGATGAGGCGATCTTTGATAAGGCGTAC<br>GACTTCAGGTTTTTCATG |
| 251 | 62 | ATGAGGGAAACCAACATCTACGAGCTCAGCGGCCTCGAAACCGTGAGTACCAGCTACAGACTTTTCGAGTTG<br>CAGGGCGCGCCAGAGTTCTCTCCTGAGTATTATGCTGGTGTGAGCCGCCTCGTGAGGACGCTTAGCAGGAGA<br>CACCAGGCACCCTTCACCAGTATCCAACGGGGCGAGACCATGTTGCTCGCTGCACCCGAGGCCCTGAGCGGT<br>GATCTCGCAGAACACCATAATCTGGCACGCTGGGTGGCGACCCTGAAGTCACTTGGAGATAGCATAGAGATA<br>GACTGCAGCGTGAGCGGAGATGAGCTGGACCCCATAAGGCTGCGATTCCTGAACTTCATGATCCAATCTCCA<br>TTGTTCAACCACGGCGAGCTCTGGCAGCCCAGGGCCGGTGATGCCTTCTACTACCGGAAGCCTGCCGACACG<br>TTCGACGGAATCGAACTGTTTGAGGGTATTGCCGTGAGGGCCGTGCCCTACCCAGGAGGCGGGTTCGGCGTT<br>ATGCTCGACGCGAGGACTAAGCTGATCTCACAGCGGGCTGTGGGCGCCTACGCGGACCCGAATTTCATAAGG<br>AGGCTGAAAAACACTAGCTGCCTGTACCGAATGGGAGACATCTGGTACGAGATAAAGATCAGTGGCGCGAAT<br>CAGACCGTTTCTCACCCCATCCTGTTTAAGGACAACCAGCCCGTGTCACTCAAAGCCTACCTGCACGAACAA<br>GCACGGCAGCCAATCCCCAAGTCTCTGATTGATCTTAAAGGTGACGGCGTGGTGTTGACCTATCGCGGCAGC<br>GATAGCGCCGAGGTCAAAGCGGCACCCGCGGAACTTTGTTTCCCCATAGTAGACACCCATAGCAAGAGGGGT<br>GCCCGGCACCAGAGAAGGAGCATCCAAGCCCCACACATCCGACGCAGCAAGGCTTACCGATTCAAGCAAAGG<br>TTCTTGCGGGACATCAAAATAGGAAATGCCGTGTTGAGCGTGGCCGACCAACCCGCAGCCCTCAAGACCAGG<br>CCCATCGACTTGCCCGAGCTGCAATTCGGCTCCAATAGGATTCTGTACGGCACGGACAGGGCGGAGACCGA<br>ATCGACCTTCGCCAGTATGCCAAGAATCGGCGAACGCTGCTGGAGCGCGCAGACGTGGGCTTCTTTGAGACT<br>TCTCCCCTGGAGCCCCAATGTTTGGTACTTCCTAAGAGCGTGATGAACGCATGGGGCAACGAGTTCGTTCGA<br>GACCTGACTGCCGAAGTGAAGCGACTCCACCCCACCGGTAACTACAAGCAACCGTAATCGCGTTTGATGAT<br>GTCAGCGCAACCGTGGACGCCAGGAGCCAAGCAGAGCCATCTTCAAGCTCGCGGAAGACGGGGATCTCCCT<br>CCAGGCGACTGCGCCATTATGATACACCGAACCAAAGGAAAGGCAAGAGCGCAGGAGGAGCTGCCCGCACTT<br>CTTATAAACAAGCTGAGAAAGAGCTACGAGTGAATGCCGCCATATTCCACGCGACTGCTGTCCCCGGCAACGCC<br>TACCGAAGGGAAAGCGCCAGCGATGGCGCTCGCTATGTGCGCAAGCGGGATGAGAAGGGCAGGTTTAGTGGA<br>TACCTGACCGGAGCGGCGCTTAACAAGATTCTTCTGCCCAACGCCAAGTGGCCCTTCGTGCTCAAGGACGAG<br>TTGGTGGCAGATATAGTGGTGGGCATAGATGTGAAACATCACACCGCAGCTCTCGTTTTGATCGCCGAAGGC<br>GGGAGGATTATCAGGCACACTCTTCGCCTCAGCACCAAGAACGAGAAACTCCCTGCTGGTATCGTGGAAACG<br>AAGCTGGTGGAACTGATTTCAAATGAAGCACCACACCTGAGCAGGCTCACCAAAACAATCGCCATCCATAGG<br>GACGGCAGGATTTGGCCCTCCGAGCTTAAGGGATTGCGAGCAGCCTGTAGGAAGCTTGCCGACGACGGCCAC<br>ATCGATCCTGCGTTCGATCTGAACGTCTTCGAGGTGAGCAAAAGTGCCCCTGCTAGGCTTAGGCTGTTTAGC<br>GTCGACCGCAGTGCTGGCAGAAAGCCGAGGATTGAAAACCCGGAACTGGGGGACTGGATGATGCTGACAGAA<br>ACCGACGGCTACGTTTGCACGACCGGTGCTCCGCTGTTGAGAGGTGGTGCGGCTAGACCCCTGCATGTAAAG<br>CAGGTCGCAGGTGATATGAGCTTGCAGGACGCCCTTTCCGACGTGTTCCGACTGAGCTGTCTGACCTGGACT<br>AGGCCCGAGTCATGTAGCAGGTTGCCTATCAGTTTGAAGCTCTGCGATATGCTGCTGATGGACGAGGGAACT<br>GCCCACGACGAGGACGAAATCCTTCATGCTAACGACGACACCCCAGCCGTTAGCGCC |
| 252 | 55 | ATGGCGTTTAGGCCCGGTGAACGAGTCAGACCGCAGCTCGCGCTGAATGCGATCAGGGTCCTTACACCCCCT<br>GGCACCATCCCCGCCAGTGTAGTCCAATTCGACAGAGCGCTGCTGCACGCATATCTTGACAGACCCGAGAAC<br>GACGTATTCGCTACCCGACACGGGGAGACTGATATGGCGGTCGTACCCCTGACCAGCGGTGCGAACCTGCCA<br>ACGGACAGAATGGGGCTTCCAGCTGCAGAGCACCTCAGGCTGGTATCTGCGCTGACAAGAGAAGCTGTGTTT<br>CGCCTCCTCGCGGCCAGCCCGGAAGCGGATCTGCTGATCCGGCGACGCCCACCGACCGTCGCGGGGAAGAGA<br>GAAAACGTACTTGCAGAGGACATTGGGCTCCCGGACTGGTTGAAGAAAAGACTTGTGCTGGAGTTCGACACG<br>CGCATATTGCAACCACCGAGAGGGGACGCCTACGTGGTGCTGACGTGTAGTAAAAGGCTGCGCACGACAATA<br>GACGCGAGTTGTCGCACCCTTCTGGAACTCGGTGTACCACTGACGGGTGCCGCAGTCAGCTCCTGGAGGGAA<br>GATCCTGACCCCAAGGTGAGCCGGCGATTGGCCTACGCTGGGCGCGTTGTAGAAGTAGGGCAGGACACGCTC<br>ACTCTGGACGACCACGGAGCTGGTCCGAGTGTTGTCTCCAGCGAAGACGTGTTCCTCGAGCCGACTCGAGCA<br>AACTTCAACAAGGTGGTGAAGTGATAACCCAGGGTAACTCCGAACGAGCCTTCAAGGCCGTACAAAAAGCA<br>GAAGCCGAATGGCACGGCGGGAGGCGGACAATCGAAATAGTGCATGGTGTCCTCAACCAACTCGGCAACCGG<br>TCAATGGTTCTTGCCGATGGCGTGCCTCTGCGGCTCGGGGGCTTGATAGACCAAGCGGTCGATAGCGACGCA<br>TTCCCCCCAGCCGAGGCGGTGTGGCGCCCTAAGCTCTCATTCGACCCCGTGCACAGCCCCGAGACATCAAAT<br>TCCTGGAAACAGCAGTCACTGGACAGGACGGGCCCTTTCGATAGGCAAACCTTTGAAACAAAGAGACCGCGA<br>ATCGCGGTTGTCCATCAGGCCGGAAGAAGGGAGGAAGTGGCTGCGGCGATGCGCGATTTCCTCCACGGAAGG<br>CCTGACATCGCCAGCGATACGGGCCTGGTTCCCCACGGTTCAGGACTCCTCGGACGCTTTAGGCTCCACGAA |

TABLE 18-continued

Argonaute and helicase DNA sequences

| SEQ ID NO | Argonaute # | Sequence |
|---|---|---|
| | | CCCGAAGTGAGATACTTTGAGGCCGCAGGCAGGGGGGACCCGCTTATGCCGACGCAGCACGGAGTGCGCTC<br>AGGGACGCGGCGTCAAGGGACGAACCATGGGACCTCGCAATGGTGCAGGTAGAGCGGGCGTGGCAAGATCGC<br>CCACATGCCGATAGCCCGTACTGGATGAGCAAGGCAACGTTTCTCAAGAGGGATGTGCCGGTGCAAGCCCTT<br>AGCACAGAAATGTTGGGTCTTGATGCATTTGGGTACGCGAACGCACTTGCGAACATGTCACTTGCAACGTAT<br>GCGAAACTGGGCGGTGCCCCGTGGCTTTTGTTTGCCAGGTCACCAACCGACCATGAACTGGTGGTCGGGCTC<br>GGAAGCCACACTGTAAAAGAGGGCCGAAGGGTGCGGGTGAGAGGTTTGTCGGTATCGCGACCGTATTCAGC<br>AGCCAGGGCCATTATTTCTTGGATGCCAGGACAGCCGCGGTCCCGTTTGAAGCCTATCCTGCTGCCTTGAGC<br>GACAGCATCGTTGACGCGATCAAAAGGATTGGACGAGAGGAAGCCTGGCGACCAGGCGAGGCCGTCAGGTTG<br>GTCTTTCACGCCTTCACCCAGTTGAGCCGAGAAACCGTTCAGGCAGTGGAGAGAGCAGTAGCAGGCATCGGG<br>GCCACCAACGTAAGCTTCGCGTTTCTGCACGTTGTCGAAGATCACCCGTTTACCATGTTTGACCGAGCGTGG<br>CCAGACGGAAAGGCGACATTCGCCCCTGAAAGAGGTCAGGCGCTTCGACTCTCCGAGCGCGAATGGTTGTTG<br>ACACTTACCGGCAGGCGCGAAGTTAAGAGCGCCAGTCACGGGCTGCCTGGGCCGGTTCTGTTGCGACTTCAT<br>GACAGCAGCACCTATAGAGACATGCCCGTGCTCGTCCGACAAGCATCCGACTTCGCCTTCCACTCTTGGCGC<br>AGTTTTGGACCCAGCGGACTCCCCATCCCGTTGGTTTACGCGGACGAAATTGCAAAACAGCTCAGCGGCTTG<br>GAAAGAACCCCCGGATGGGACACGGATGCGGCTGAGGGTGGCCGGGTTATGAGAAAGCCTTGGTTTCTG |

TABLE 19

Argonaute nucleic acid sequences containing 2 nuclear localization sequences and a cloning sequence

| SEQ ID NO | Argonaute | Sequence |
|---|---|---|
| 253 | 36 | GGTGTCGTGAGGATCCATGCCTAAGAAGAAAAGAAAGGTGGAGGATCCAAAGAAAAAACGCAAGGTGGGTAG<br>CGGCAGCATGCCATCAGCCGAGAGGTGCATCTGGGAGTGGAAGAGGGAAATCTTCATCACTAAAAACCCCTT<br>GCTCAGGGAAACCGTCGGCGAGCTGTCCCTCCAGGGCACGAAGGACCGAATCCAAAAATGGCTCGATCAACG<br>CGGCGAATACCCCGCACTGAACTCCCCAGAGGAATACTCATTTTATGCCGAGGAGTGCTACATCACCGAACA<br>AGACAGGCGGAGCTTTTTTCAGCAGTACGTAGAGGTCGCCAAGCCGCACATAGGTTATAGATTGTTGCCCCT<br>GCTGGCACAGACCAAGATCATAAAAACTGTATGGACGACTAACTTTGACGGGCTTGTCGCCAGGGCCTGTCA<br>TTCCAACGACGTGGTGTGCATCGAAGTCGGTCTCGACAATACCCAACGCATTACGCGCCAGCATTCTGAGGG<br>GGAGCTGCGGGTTGTAAGTCTCCACGGCGACTACCGATACGATGAGCTTAAGAATACAGATGAGCAGCTCAG<br>GTACCAGGAGGAGGCGCTTAAAAACAATATAGAGCACGAGCTGCAGGACTACGACCTGGTAGTGATCGGTTA<br>CTCCGGCAGGGACCGGAGCCTCATGAACGTACTCGAAAACATATTCAGCAAGGCCGTGAAGACAGGTTGTT<br>TTGGTGTGGCTACGGCGAAACGATAAGCCAGCCCGTTATGGAGTTGTTGGAGCTGGCCCGCAAGAATAATCG<br>AGACGCATTCTATGTCAGCACCGAAGGCTTCGACGACACCGTTGAAAGAATCAGTAGGAAGCTGCTTGACGG<br>CAACATGCTGTCCAAAGCCTTGGCTGAGATACAGGAGACCACTTGCATCACCAACCAATCTGCCAAATTCAC<br>CGCACCTGAAAACGACATCAGCAGCCTTATTAAGTCAAACGCATACCCCCTCCTGAAGCTCCCGTCTCAGTT<br>CCTTAAAGTGACCCTCAAATACCCGGAGGGGTCCTTTAGTTACATTGATTGGCTTAACTCCAAGGTTGACTT<br>CAAGGAGGTTGTGTTGTCTAAGATAGACAAGGAGATCATCGCGTTCGCGGATGTTGATAAGCTGAGGAAGTA<br>TCTGGGCGAGTTCTACCTGTCTACGCCCACGGTGGTGAACTTTAGCAAAACGGACGTGCTTAACGATACTCG<br>CATTCAGAGTCTGGTGAGGCGCGGACTTATACAGTCCATCGTAAAAAACCTGAACCTGTCCAGCGACCAGAA<br>CAAGCGAATATGGAATCCAGACGTGAGCTCCATCGAATTCTACAACGGCAAGAAGTACAAAATCATCGACGC<br>GCTCATCCTCAATCTTAGTTTTATCAAAGATGACATCTACCTCACGTTCAAACCCGATCTGCTGGTCCTTAA<br>CCTCGACGAGAGCCTGCCAGACAACGATATAGTTTAGACTATCAAGAACAAAAAGTTCGGCTACCAGCACAA<br>CAAAGAGTACAGTCAGATCCTGGAGAAGTGGGCCAACCTTATAACGAAGAAGGATTTGGTCGTGAGTGGCGG<br>GAGCGTGTTCTTCCTTGGGAAGAAACCGCTGTATGCCGGACTTGTGTCTTACGCCGCGAGGAAACTCCCAAC<br>AGATTATAACAAGCACGCCACCCAGAAAGGACTGATCATTCAAGACGCGAAACTGATTTTTTGCAGCAATTC<br>CATCTCCAATGAGATTTCTCACATCAACCCCCTGAAGGGGCTCGTGGAAAATCGCCCGTGGGACTACAAAAA<br>CACCAGCTCTGGGCTGTGCCCCGAGATCTGCATTAACGTGATCTCAACCAGGCAGGACGCGGGTGTGGTGAG<br>CAACCTTCTCCGAGGTATTCACGAGAAGTCCTTCCCGGAAAAATCCGAGCAAGATTACTTGCACCCCTTCCA<br>TGGGTTCACAAACGCTTTCGGGGTGCCCATCACGATCCCTAAGATCGGTGAGAATACGTGGCGCTTTGTGGA<br>CGAAGCACTGAGTGCACAGAAGGCCATCGATAACGCGAAGAACCTCGCGAACCGCATTTGCTATGAACTTGA<br>CAGCCTGAAGAAGCTTGAACTGCGACGGGCACCGTCGTGATCATATACATCCCCAAGAGATGGGAAGCATT<br>GACATCCATCAAGTCTGAGCATGAGTACTTCGACCTGCATGATTACATCAAGGCCTATGCTGCGCAACAGGG<br>CATTAGTACGCAATTCGTGCGCGAGAAAACGGTTAATTCAAGCCAAAGCTGCCGGGTAAAATGGTGGCTCAG<br>CCTGGCGTTCTACGTGAAGGCTATGCGCACTCCGTGGCGGTTGGAGAGTATTGATAACCAAACGGCTTTCGT<br>GGGGATAGGGTACAGCATCAATCGCAATATGCATCCCGAGAATTCCAAGCGGATAATTCTTGGATGCTCCCA<br>CATATACTCCGCCCGAGGCGAAGGCATGCAGTTTCAACTTGGGCGAATTGAAAATCCCATTATCCACCATCA<br>CAATCCCTACATGAGCGAGGAGGACGCTAGACGCACCGGCGAGAAGATACGACAAATGTTTTTTGATGCCAA<br>GATGCAACTGCCACGCAGGGTCGTCATCCACAAGAGGACCGCTTTCACTGAAGAGGAACAGCGGGGGTTCAT<br>ACAAGGATTGGAAGGCGTTGAGGACATCGAGCTGATCGAAATTAACTTCGAGGACTCCCTCCGCTATTTGTC<br>TAGTAAGTTTGTAAACAGCAAGCTGGAAATCGACGGGTTCCCCATCGCTCGGGGGACCGTAATCGTGCAAAG<br>CAGCAACACCGCGCTCCTGTGGGTGCATGGTGCAACCCCTAGCGCGCAAAATCCAACGTTTAAGTATTTCCA<br>AGGCAAACGACGGATCCCCGTGCCCCTTGTCATAAAGCGCTACGTGGGGCAGAGCGACATTAGCCAGTTGGC<br>GAACGAAATATTGGGCCTCAGCAAAATGAACTGGAACACCTTTGACTATTACTCCAGGCTTCCTGTAACCCT<br>TGAGAGCGCCAATGATATTGCCCGGATCGGCGTGTATTTCAACAATTTCTCCCCCATGAGCTACGACTATCG<br>GCTCCTCATATAGTAACTCGAGGTTAACTTGT |
| 254 | 90 | GGTGTCGTGAGGATCCATGCCTAAAAAAAAAGGAAAGTCGAAGATCCGAAAAAGAAACGCAAAGTAGGGAG<br>TGGTAGCATGATCAAACACCTCAAGTTCGACGAGTTCCTTCGCAGCGTGTCAATTAGTAAGGATAACACGTA<br>CTCCATGCTTATCGGTGCCGGGTGCTCAATCACTAGTGATATCCAATCTGCCTATGACTGCATATGGGAATG |

TABLE 19-continued

Argonaute nucleic acid sequences containing 2 nuclear localization sequences and a cloning sequence

| SEQ ID NO | Argonaute | Sequence |
|---|---|---|
|  |  | GAAGAAAATAATTTACAAGTCCAATAACTTGAATACTCAGGACTGGATAGAGAATTACAAATCCCCCAAAAC<br>ACAAGACGTGATACAAAAATGGCTTGACAACCAGGGAAACAACCCTGAGAAAGATAATATCGAAGAGTACTC<br>ATTCTACGCAAAGAAATGCTTTCCGATAGATGAAAATAGACGCCAGTACTTCCAAAAAATCTGCGCTAATAA<br>GAAGCCCAGCGTCGGATATCGAGCCATTCCTCTCCTGGTGAAGCAAGGCATGCTCGACTCAATTTGGACAAC<br>CAATTTTGATGATCTTGTTAATGTGGCGTGTATAGGTGGTGGCGTTCAGGGGATTGACATATCCCTTCAGAC<br>GGTAAACCGCATAAATCAACGCAATCAAAGCAAAAATGAACTGCCTATTATAAAGCTCCACGGGGATTTCAA<br>GTATGGCGACCTTAAGAACACGAGTGAGGAACTTCAGAATCAAGACGAAACGCTTAGATCAAAACTTTTGGA<br>CTACTTGAGCGATAAGAATCTCATAGTCATTGGCTATAGTGGTCGGGACAACTCACTCATGGAGAGCTTGAA<br>AGAGACTTATTCAAAACCTGGTGCGGGAATATTGTTTTGGTGTGGGTATGGGAACAGTCCATCAAACCAAGT<br>GAAGGAACTCCTTAAATTTATCAAGGATAAGGGGCGCAGCGCATTCTATGTTTCCACTGAGGGATTCGATAA<br>CACCATGCTGAACCTGACCAAGCATGTTATTGAGGACGATGATAACCTCAAAGAGGAATTCAGAGAACTCAA<br>GAAGAGTATCATTAATAAAAATACAACGACCCCGTTTACGTTGAACCCGGAACGAATCAATAAGGTACTGAA<br>AAGTAACCTCTTTCCTATTACATTCCCCAAAGAGATCTTCGTATTCAATGCGACCTTCGATAAGAAACCTTG<br>GGAGCTTGTTAAGGAAAAAACTCTGAGTGACTATGAAATTTCAGCGATTCCATTTGAAAAAGACATATGGGC<br>ATTTGGGACTGCTAATAACGTCTACGAAAAGTTTGCAGATATCATTAAGGGCGAGATCCAACGGAAGCCCCT<br>GACCGATATCCGGCTTTATAATCACAACATAAAGTTCCTGCTCCTGTCAAGCCTCTGCAAGCTGTTCTCAAA<br>AACCTACAATCTGAAAACGGACTTTCGGTCTAAGATTTGGGATGAGAGCTCATACAAAACGGTTCACAACCA<br>AAAGGTCTATAACGCTATAAAGATCGATCTCGTCAAAATACAAGAACAGTCATATTTGTCACTCAATCCAGA<br>CTTTCAATTGGCAGATGATAACGTTCCCAATGATATCAACCAGCAGGTTGGACTGGAATTTTTTCATAAGAT<br>CTATAACGACAAATTTAACGACTATATAAACATCTGGAGAAAGAAGATCCTCGAAACTACGTCATACGAATT<br>GCCACTGAACTCCGGCACCGGGTTCGTATTTAAAATCTCTAAGAATCCAATTTTCACAAATATAGATGACCT<br>TAATTCCAACTATACGAACGAGCACAATATACCCATAAACATGATTAAACTTAAGGGGGTTCAATTCAAAGA<br>GACGAACCTCCTCTTTAGTTCACAAAATGGAGATAAAGTGGTTAAGGAGACCCACCCAATGAGAGGCCTCGT<br>CAATACATAGCCCGTTCGATAAGGGATTGAGTAGTCTTAAAAACACTACGATCAACCTGGGGATCGTATGCCC<br>CCAACAGGATAGCGAAAATTTTTATACTTTTTTGAATAAACAAAACCAAGAGATTAAGAACGTTAATATTAA<br>GGATCAATATGTAATCGATTACAAAGGATTTCACAACACATACGGTTTGAGTCTGAACATACCTACTACGAG<br>CAGTCCTAATTGGGAAATGACTAACGAGCCTGTCTCAAGGGACTCAAAGAAAATAATTCATGAAATCAAGAA<br>TAATATTTGCGACAAGATAAATAAGCTTTGTAGTATAGGCGGACAGAAGACAATAGTAATATTTATCCCTAA<br>ACGCTGGGACAACTTCGTACACTATAATGATGCCGTGGAAAGCTTTGATCTTCACGATTATATCAAAGCGTT<br>CTGTACCGAAAAAAAGGTTACGTCTCAGTTGATACGGGAAAAGACGATACTCGATAATAACCTCGAGTGCCA<br>GATCAACTGGTGGTTGTCACTCAGTTATTTTGTAAAGTCCTTCCGAACACCGTGGGTAATCGACAACACCGA<br>CAATAAAACAGCTTTTGCGGGCATTGGTTATTCAGTAGAGTCCAAAAAAGAGGATAAGGGGCACATTATACT<br>TGGCTGTTCCCATATTTACAGTAGTAACGGGGAGGGTCTCAAGTATAAGCTTTCCAAGGTTAATGATAAAAT<br>AGAATGGATCAAGAAAAAGCCGCATCTGTCCTACGACGATGCTTACGAATTTGGTAAAAATGTGATCAACCT<br>GTTTTACGAAAGCATGAATGAGGTGCCAAAACGAGTGGTAATTCACAAACGCACCTTTTACACTGAAGATGA<br>GAAGCAAGGCATACTTGACTCTTTGCACGATAACAAGAAAATAGAAAACATAGACTTGATAGAAATAAATTT<br>CGAAGCAACATAAGGTACGTCTCCTCTAAGATATATAATCGGGAGGCAAAAATCGACGGTTACTCAGTATC<br>ACGCGGTACCTGTATCCTTCTTAACGAAAAAGAGGCACTTTTGTACGCCCATGGCGTAATCCCGAGCGTGAA<br>GAATCCGAGTTATAATTTTTATCCGGGAGGAAGGTACATACCGAAGCCATTGAGGATAATAAAGCATTATGG<br>AGTTGGTTCCCTGGAACAAATAGCAAATGAAATACTGGGTCTCACTAAGATGAACTGGAACTCTCTGAACAT<br>GTATAGCCAAATGCCTGCCACGATCGACTCAAGTAATAAGATAGCCAAAATAGGGAAACTCATAGAGAATAG<br>GGATAAAGTAGAGTACGATTATCGGTATTTTATCTAGTAACTCGAGGTTAACTTGT |
| 255 | 18 | GGTGTCGTGAGGATCCATGCCTAAGAAGAAGAGGAAAGTGGAGGATCCCAAAAAGAAACGAAAGGTCGGCAG<br>CGGTTCTATGAGCGAGCTGGAGACCAACATCTTCCCAATCACCAACTTGCATGAGCTTGAAAGCAGGTTCAG<br>GTTGTATAGGGTGAGGGGCCTGAGCATCAACCAAGAGGAGTACGACCCCAACACCCAGACATTGGTGAGGAA<br>GCTGAGCTACAGCATGAGGTCTCCCGTAGCTGTGATACTTAGGAACAGCGACCCGTTCCTGGCTCTTCCAAT<br>CGACGCACCCGAGCCCATCTCTCCGTACCCGCTCGTGAGAGCCACTGCTGTGTTCAGAAGACGGACGAGGT<br>ATTTACTCTCGATTACGAAAGCCCAACTCCCGAGACAGATGCGCTGCGAATAAGGTTCCTGCAATTTATCAT<br>CCAAGGCGCGCTGTTTAGGAATCCCAGCCTGTGGCAGCCCTCAGCTGGCACCCCCTTCTTCGAGAGGAGCCC<br>CGTGTTGGAGAAGGCCGGCATTTGCGCGTACCGAGGCTTCTCAGTGCGAGTCGTGCCCATAGAAGGTGGTAA<br>ACTGGGAATCTGTGTGGACGTTAAGCACAGGTACGTCAGCAAAAACCCCATCGAAGCAAACATCAAGCGCGA<br>GGAATTCAGGAAATACAAGAACGGCAGGTGCATATACCACTACGGCCACAACTGGTACGAGATCAAGTTGCA<br>AGACCACACTGGGCTGTCCGTGTCAGAGCAGATGATCAGCAACGGGACGGCAAACCCATAAGCTTGTATCA<br>GTTCATTATGAATAACGCGCCAAGCCCCTGCCCAGGGAGGTCATAGACATGCCTCCCGACTCACCCGCAGT<br>CAAATACATGACCAGCAGGGATGAGGTGCGCTACGTGCCCTCCATCCTTTGTTATCCGGTCTTTGACACCTC<br>TGACCCCAGGGTGAAGCCGACGCATAGGGGCACAATCCTCCCTCCCTAACGTGAGGCGACAGTATATCCACAA<br>TTTCGTGAACTCACACCTGACCGATGTGCGATCCAAAGACATGGCAATCCGAATCAGCAGCAAGCCAGTTAT<br>CGCCCCTACCAAGATTTTCCTGCCGCCTGACCTGGCATTCGGCAACAACACCGTGTTCAGCGTAAGAGGCAC<br>ACCCGGGACCACGTATGTTAGCCTGGAGCAGCTGGGCCAGACGCGGATAAGCGCCCTCTTCAATCAGAAAAT<br>AGGCCCTTATGACAGCAGGCCGCTGGATAGGCAGTACATGATTCTGCCGAAAAGCGTGTGGGACTCCCACGG<br>GCCAGTATTTCTGAATGACTTTAAGAAAATCATGAACGAGCTGTACCTGCACGAACTGCCCTACAATCCCAT<br>CGTCGTGACCTACAACGACTTGAGCGCCAAGACCTACGCGCTTCAGGGAAGGGCTATTCTGGACGCCGTGGA<br>CAGCGAACTGAGAGAGCCGGGATACGGCGTGGTTATGATACACGAGACGGTGGACCGCCGGAATAGACAGCA<br>CGACCAGCTTGCCGCGATGGTGATGAGGGAGCTGCGGAACAGGAGGCTGTATGTGAGCGTGATCCATACCAC<br>GGTGACGAAGGACTGTTACCAATTGCCCCAGAACGCCCCCATTGGCAAGGCCTACTGCCCGGTAGCAGGCAA<br>GCAGGGCAAACTCAATGGCTACTTGAGGAACGTGGCCATTACCAAGGTGCTTCTGACCAACGAGAGGTGGCC<br>CTTCGTTATATCTACCCCGCTGCATGCGGACTTTACCGTTGCCTTCGACGTGCAGCTTAACACCGCTTGCTT<br>CACATTCATCGGCAAGAGCGGCTCCGACATCCGGACCGTTTTGAACGACCAGTAACCAAAAGGAGAGGTTGAG<br>CAAGGCACAAGTAAGGCAGACGCTCCTGGAAGTGCTCCGCCAGGAGGTTGGCTTCGGTCGACGGACCATGCA<br>GACCATAGTGGTTCAGGGGATGGCAAATTGTTTGCCAGTGAGATCGCGGGAGCAAAAGACGCTATAGAGAT<br>AGTGAAGAAAGAAGGCATCTTGCCCAGCGATGTGTCACTGAATTTCATCGAAATCCCCAAGAGCAGCGTCGC<br>CCCATTTAGGCTGTTCGATAGCAGCCCCAGGCCAGGGCAGCCTGAAATGGCGAACAACCCAAGAATCGGCTC<br>CTACTTCATCGCGACGAATTACGACGGTTACATTTGCACCACCGGCAAGGAGTTTTACCATCCCGGTACGGC |

TABLE 19-continued

Argonaute nucleic acid sequences containing 2 nuclear localization sequences and a cloning sequence

| SEQ ID NO | Argonaute | Sequence |
|---|---|---|
| | | AAATCCTCTCCACGTGAAGTACATCGAGGGAAATATGCCATTTGAGAAGATCCTGGAGGACGTGTACGCCTT GACTTGCTTGGCGTTGACCAGGCCCGAAGACTGCACAAGGGAACCCTTCACCATGAAACTGGCCGATATCCG ACTGAGGGAACATGCCGGAGGCTACGACGAAGATGCATTGGCGTATGATGATGAAATGAGAACGACGAGGA TAACGAGAATGAATAGTAACTCGAGGTTAACTTGT |
| 256 | 57 | GGTGTCGTGAGGATCCATGCCCAAAAAGAAGAGGAAAGTGGAGGATCCAAAGAAAAAGAGAAAGGTGGGTAG CGGAAGCATGACCGAGGCCTTCCTCACAACCAGGAGGGGCTTCGTGCAAAAGCTGACGCTGACCAGGTACGA TTACCTGAACTGGATCATCGAGTCCGAGGCGCAGAAAGCCAAGCTGAAGAACTGGCTTAAGAACAAGAGCGG GTTTCTGACCCACGAGATCGAGGATACCTGTTTCTTCACCTTCGAGAGGCTTCTGGAGGAGAGTACTAAGCA GTATAGAGCCTCCGGCGAGAAAACTCTGTCTGCCCCGTTCAAGAACACGCAACTGATCTCAAATCTGATCGG TACCATATTGAAAAAGGAGTTGAGCAAGAAATACAAGCAATTCTTTAGTCAAAACATCTTCATCGTGAGCAC CATCGATCTGTATCCATTCAATCTCTTGAAGGCGTTCGAGTTCAACATCGAAGTGTTTGACAGCGGCCACTT CCTTATCCACGTCAACCCAGTGTCTAAAATTGTAAGCAGCAAGGTTGTGGACAAGGAGTATCTGGACTACCT CAAGAAAAGCAACCTCAACAACAGCAAAACCACCGAGATGGAGTTCGCGGTGATCAACCATGAAAGGAATTT CAGACTTAAATTCGACCTGCTTGACGAATGCATCTTTGAGAAGATAGAGAAGCTGCACAGCGAGAAGAATAT GTTTACAGCCACTTTTGATTACCATTTCCTGGCCAACTTCAGCCCCGAGATCTTCGGCAAAATCGTGGAACA TACTAGCAAGGATCTGAAGCAGGCCATCATGTTCCTGAATGACATACTGAGCAATATCAAGCTGCCGAGCTT TCTCAACCTGCACGAGGAACGATACTTTAAGGTCAATATCTCCGAATTGGACCGAAAGAATAATCTTCTGAT TGGAAGCAGTTTCGAGGTAATAACCATATACTCAAAAAGCCAGACCCAGTATGGACTGAGGATTGAGTTCAC TCGCGACAGCATAAGCCGGGACGAGCTTATAACAATCTTTCTGAAAAACGAAGAGCTGATCGAGAAACTCAA CGACATTAAAGTGGTCCCCGCCACCATCAACGCAAAAATCGAACAGAAGACCGGCTGGAAAAACCCCTACAT CACCAATGTTTTCATCGATAACGTGGGTGCCTTCAGCACCAGCAGCCTGCAAAGCGCCTCATACTTCCACGG CATCTACAAGGCCGTTAACAACTGGAATATCCTGCCCATCGTGTACGAGGACCTCGACATCAAAGTATTCGA GAACCTGATGCTGCACGCCTTTAACAAGAACGCCACCGAATTCAAGATCCTGGAACCCATCATAATCAAGTC CACGAACGAAATCGACAAACAGGAGGTGCAGAGGAGCATCAAAAACCAGGCCGGCAAGACCATGATCGCAGT GTTCTGCAAGTACAAGATACCCCATGACAGCTTCGCCCCCCTCAAGGGCTTCAAGTATCAGATCTATCAAGG CGACACCACGGACAATAAGCAGAATAGGGCCAAACTGAGTAACTTCACGTGCAAGTGCCTGGAGAAAATGGG AGGGGTGATTGCGGCAATCGCGGACACAAGCATAGCCGAGGATGGATATTTCATTGGCATCGACCTTGGCCA CACCACAAATGGCAAGGAAAAGTTCTCCAACCTCGGGAGTTGGCCTTGTTTGATAGCCTGGGCATCCTGTTGGG CGATTACGTGGAGAAGGAGATTCCAAGAAGGGAAAACCTCATCGACACGAACTGCCTCAATGCTTTTAAGAA ACTTGACAAAATGCTGGAAGCTAAAAAACTGAACAAGCCCAAACACCTGATCATCCATCGGGACGGCAAACT GCACTTCAAGGATATCAACATTCTCGTAAGCTGCGTGGAAACCGTGTGGGTAAGATAAACGTCGATATAGT CGAGATCATTAAGAGTGGCTTCCCCGTGATGGCTATAAAGGACGAGACCAACAAACCAATCAATCCCATAAG CGGGACCAGCTACCAGGACGACATCCATAAGTACGCCTATCTCGCCAACGTACAAGCCGACGAACAGTC AGCCGTAATAAACCCGATAATCATAAAACACAAATACGGAGAGCTGGAGTTTAGCAAAATAGTTGAACAGGT GTACTGGTTCACGAAAGTGTATACCAATAACCTGTACAATAGTACCAGGCTCCCAGCGACTACACTCAAGGC CAACAACGTGGTTGGCACGTCTAAGAAGCTCCACAGAAGTACATACTTGGGCTAGTAACTCGAGGTTAACTT GT |
| 257 | 59 | GGTGTCGTGAGGATCCATGCCGAAGAAGAAACGAAAGGTGGAGGACCCAAAAAAGAAGCGGAAAGTGGGGAG TGGCAGCATGTTCGTGGAACTGAACGCCTTCCCCATCGACATCCGCAATATCGGTATCGTGGAGGCCTGCGA GGTGCCGTACGACAAGGAGGTGCTTTATAGCCTGCATGATAACCCACAAAAAGATTACCATGCTATCAGAAA CGGCAACCAGATATTGATATTTTCTAATAGCAAAAACTACCCCATCCAGGGTACAATCAAGGAGATAAATCT TGCACAGGACTACCGCATCCTGTTTTTCCTTATTAAGGAGTCCATTATCAAGATCCTGACGCAGATCAAACG GGAGCCTTTCAAGTTCAACCCCGATTGAGTTCATCTCACCAAAGGAGAACATCACCGAGAATATCCTGGGAAT CAATTACCCATTTCAAATAAACGCCAAATATTCAATCGATACCAGAATCATTCAGGGGGTGCCCTGCCTCAC CATTGATTGCAGCACGAAGAAATACAACAAGGAATCCCTGATCTACTTCATTAACGACGGCTTCAACCTGAT TAACAGGTACGTGATCTCAAAGCAAAACGAGAAGTATAAGCGCGTAGGTAAGATACTGAGCATTGACAACAA CATCGTGACTGTTCAGAGCTGCGACAAGATAAAGAAGTACTCCGCCGAGGAAATCACCTTGGAGGCGAACTC TAAGACACCAAGGACTATCTGGCATACAAGTTCCCCTATAAGTTCGAGCAGATCCAAGAAAGCATTAAGAA GGCGATCAGTACCTTCACCCAGGGGACCTCTAAGCAGATAAACATTGGCAAGATCTGGGACTTTTTCAGCCA GAAAGGCATCTTCCTGTTCAACGGCCACCGAATTAACATAGGGCTGCCTCCCGACATCTCCCAGCAATGCAA GAACCTTGTGTACCCGCGCTTTTTCTTTAGCAACTCCCGAGAAAACAATTCCAAAGAGAACGGCCTGAAGGA TTATGGCCCTTACACCAGGAATTACTTTGACAGGAATAACCCCAGCATTTGCGTGATTTGCAACGCTAAGGA ACAAGGCAAAGTGGAACAGTTCCTGCACAAATTTCTGAAGGGCATACCCAATAGCCATAACTTTAAGACGGG CTTCGAGGGCAAGTTTCATATTGGCCTCTCTCAGATAGAATTTTTCACGACCAGCGACGACAGCCTGGGCAG CTACCAGTTGGCTATCCAGAAGGCAATCCAAACGAGGACTAACCAAAACTCTAGCCAGTGGGACCTGGCCCT GGTGCAAACCAGGCAGTCCTTCAAGAAATTGTTGGTGGAGCAGAATCCGTACTTTATTAGCAAGAAAATGTT CTTTCAGCATCAGATCCCCGTTCAAGACTTCACCATCGAGCTGACCAATCAGAACGACAAAAACCTGGAGTA TTCTCTGAATAACATGGCTCTGGCGTGCTATGCGAAGATGAATGGAAAGCCCTGGCTGCTTAAATCAAGCCC TACTATCAGTCATGAGCTGGTTATTGGCATCGGGAGCAGCAACATCATCATCGAGGAGGACAGTCTGAACCA GAGGATCATGGGCATCACCACCGTGTTCAGCGGCGACGGGTCTTACATGGTCTCAAACACTAGCAAGGCGGT GGCGCCCAATGAGTACTGTTGCGCCCTCATAGACACACTTGAGCAAACGATCAAGAGCTGGAGAAACTTAT GAACTGGCAGAGCAATGACACCATTAGGCTCATCTTTCATGCCGCCGTGAAGACCTTCAACAAAAATGAAAT CCTCGCCGTAAAGGAAGTGATCAAAAAGTATAGTGACGACGTGCGACTACGCTTTTCTCAAAATCAGCAG CGACCACGGTCTGCACCTGTTCGACCCACTCAACTAAGAATGAGAATAAGGGTAAATTGGCTCCCAAGAGGG TAAGTATTTTGAACTGAGTAGCCATGAAATTTTGCTGTACCTCGTGGGCAGAAAGAGCTGAAGCAGGTGAG CGATGGCCACCCCCAGGGCGTGATCGTGTCCCTGCATAAGGACAGCAGCTTTCAGGACCTTAAGTACCTCTC TAATCAGATTTTCAGTTTTAGCTCCCACAGTTGGAGGAGCTACTTTCCCTCTCCCCTGCCCGTGACAATTCA TTATAGCGATCTCATCGCGGAGAACCTGGGCTGGCTTAACAAGCTGAGCGGCTGGGACGATACAATCCTGCT GGGCAAACTTGGACAGACCCCAGTGGTTTCTGTAGTAACTCGAGGTTAACTTGT |

TABLE 19-continued

Argonaute nucleic acid sequences containing 2 nuclear localization sequences and a cloning sequence

| SEQ ID NO | Argonaute | Sequence |
|---|---|---|
| 258 | 73 | GGTGTCGTGAGGATCCATGCCTAAGAAAAAGAGGAAAGTTGAGGATCCAAAAAAGAAACGAAAGGTAGGCAG<br>CGGCAGCGTAAAGCTTAATCACTTCCCCCTGAATCCCGCTCTTGCAGTGTTCAAGACTACCTACAGGCACAG<br>AAACCCCAGGGGCTTCCTGGGATTCGTTAGGTCACAAGGGTTGACCGCGGAGAGAGTTGGCGAGGAAGTGTG<br>TGTCTATCACGGTCTTCCCCACCCGGCTTTTAGAGGAGCCACCGCCCAAGGACACACCAGACTGGCGCCTGG<br>TGACACCGATTACGACAGGGGCGTACTTAGTCTGATCGGAGCCGCCCTGCTGAAAGCGGGTTACGTGCTTAC<br>TGAGCGCGAAAGGGCCGCAGTGCACCCCACGCAGCAGAGAGTGCCCCTGCACACCCCTAGGAAACTCCCTGC<br>CGAAATTGCGGTGAATGCCCATCTTCGATGGGAATGGGAACTGGAACGGCACAGCGGGAAGTCTTGGCTTGT<br>GCTTAGGCCCGGACGCATGTTTTTGAGTGCGCTGAGCTGGCACGATTTGGACCTGAGGGCATGGGCACAGGA<br>GTTGCCCCAGAGCGTACAGCAACTGCACGCGCTGTGTCTTCGCTCCGGACGACGAGAACGACTGAGGCGCAT<br>GGGTAACACGTGGGCGTTCCAACGAGAGGATAGGGAGCAAGAGGGCAGGTGGCACCTGAGCTTTAGCACTAA<br>GGCGCTTTCCGACCTGAACCTGTCCGGCGATGCTCACCATGCTGCTAGCCTGAGCATGCCCGATGTGCAGAG<br>GCTCGTAAATCTGCCGGGTCTGTGGCAGCCCTTTGTGACAAGCCTTGAAGTCCTTGAGGTGCCTGGTAAGGT<br>GATCGAGGGCAAAAGGCTGAGGTTCGGACGAGGAACAGGGCGCGACGTCACGGATGTACACAAAAGGGGCAT<br>CCTTCACCCTCCGCCGCAGCCAGTGCGCCTTGCGGTCGTGCCCCCCATTCAGGCGGACGAAGAGGCGGATGA<br>GCAGTTGAGACGCGAGCTCCTTGCCCACCTCCTGCCACGGGAAAAGGTGTTGGCCCACCCCGAGGCTTCCCA<br>GGGCCTCAAGAAGCACTTGAATCGAAGGGAAACCGACGACACCTTCTACACCCTGTGGAGCGCTGGAGACTA<br>CTGCAAACTGGGGCTGGAACCCTTTGATCTGGTGCGCGACCTCCATAGGTACGACCCCGGCACGGGTCGCCT<br>GCTGGCTCCAGAGAAGTTGCATGGAGCAGCAGCCGCCGCGAGAGAGGCTGGCAGGCAATTGATTGGCCTCGT<br>GATCCTGCCCGACACCATAGGGCGAGATGAGAGGGACGCACTGTCCGACGAACTGGCCAAGCTGGGTGTGAA<br>GAAACTTCAGCACATCCGCAGGGACATGCTGAACCGGCCCAGGACGCAGTATATGGCCTGGGTGAACGTGGC<br>CGTGAAGCTCGCCCAGAGGGCCGGAGCAGTCAGCTGGGACCTGGAAAAGTTGCCTGGAGTGTGCGAACAGAC<br>CTTCTTCGTTGGCGTGGATCTGGGCCATGACCATCGGGAGAAGCAAAGCGTCCCGGCCTTCAGCCTGCACGA<br>GTTCCGAGGCAGGCCGGTCGACTGCCTCACCCTTCCAAGGCGAGCCGGAAATGAAAGGTTGAGCCTGGCGGA<br>GCTGAATCAAGGCCTGAGGAAGCTGCTTAAGGGTAAGAGGCCAGCCCAAGTGATAGTGCATAGGGACGGCAA<br>GTACCTGGAGGGGGAGGTTGATGACTTCATAATCGCTTTGAACGACCTCGGCGTGCCGCGCGTCAGTCTTCT<br>CGCCGTCAAAAAGTCCAACCTCTCCATGGTTGCCGGCGCTAAGGAGGGAGCGTTTTTGCCACTGGACGAGCG<br>GCGGTGTCTGCTGGTTACCAATACCCAAGCCGCGGTAGCTAGGCCGACAGAGCTGGAGGTGATGCACTCAGA<br>TCATCTGACTTTCGCCGAGCTGACCGAGCAAGTGTTCTGGCTGACCCGAGTATTCATGAACAACGCACAGCA<br>TGCGGGTAGCGACCCTGCTACCGTAGAGTGGGCGAACGGGATCGCTAGGACCGGAAAGAGAATTGCCCTGTC<br>TGGGTGGTCCGCCTAGTAACTCGAGGTTAACTTGT |
| 259 | 72 (Helicase) | GGTGTCGTGAGGATCCATGCCGAAGAAAAAACGGAAGGTGGAGGACCCCAAAAAGAAACGCAAAGTGGGTAG<br>CGGCTCAATGCTCGACTTTAGCCTTACCCAGAAAGGTTGGGTGCTGCCCATCGTACTGAACGCCTTTCCGCT<br>CAAGGTACCGGACATGGAGCTCAAATTCGTGCAGATCCCCTACGACAAGACGACCCTGGACTCACTGAGGTC<br>AAGCCACAAGATGACCCACGTCTTCAGGAGGCAAGGCGACAGTATCCAGATCTTTTCTAGCGACGGCACCTT<br>TCCAAAGAGCGGCACCCCCCAGACCCTCCAACTGAAGGATAATCTGGGAATCTTTTTCTCTCTTGTAAAGGA<br>CGGCCTCCTCAAGCACTTCGCCGGTTTGGGCGAACCCCGTGCGGATTCAACCCCATTGAGGTCGTGTCAGC<br>TCAGGCCAAAGACAATCTTCTGGCTAGCATCCTCGGAGAAGCCTACCCGCTGAAAATTTGCGCCAAGTACTC<br>CATCGACACCAGGACAGTGCAAGGTCAACCGTGTCTCATCATCGACTGCAGCACTAGGAGAGTGGTTAAAGA<br>GAACTGCCTCTTCTTCCTTAAGACCGGCTTTAACGTGATTGGCCGCTATGTAGTGACCGAGCAGGACGACGG<br>GTTTCGGAAGCTGCTGGGTTTTGTGGAAAACTGCCACGAAGGCAGGACACTGAGCGTTATAAGGCCAGATGG<br>CCAAGCCGTGCATGCCGAGGCCAAGGACGTGTATCTCGAGGCATCTAGGGCAACTTCGACGACTACATCCT<br>TTATACGCACGGAACTAAAAAGGATACATCGTGGAGCGAATCAGACAAAGCGTGAGTATCTTCAACGGCGG<br>TAAGAACAAGAAAGATAGAATCGACGCGCTCAAAAAGTACATCCAGGCCACCAATATAAGCCTTTTGGATGG<br>GACCAGGATCGAAATCGAGGGAGCCCAGCGACATTCAGAAGGACTGCGCCCAGATGCAGAAGCCCGTGTTTGT<br>GTTCAATGACAATGGCGAGGCCGACTGGACCGAGAAGGGGCTGACTCAGAACGGCCCCTACACCAAGCGCAC<br>CTTCGACCGAAACGACCCCAGCATCTGCGTGATCTGCGCACAACACGACAGGGGGCGAGTGGAGCAGTTCGT<br>TAGGAAACTGCTGAAAGGCATGGCTAACAGCAAATACTTCAGAAAACGGCCTTGAGGGCAAGTTCGCGCTGGG<br>AACGTCCCGGGTAGAGGTGTTTGAGACCAGCACAAATAGCGTGGACGCCTATAAGAGCGCGATCGAAGCCGC<br>CATCCGCAAGAAGGCCGATGACGGCGGCAGGTGGGACCTGGCATTGGTTCAAGTTAGGCAGAGCTTCAAGCA<br>GCTGAAGGTGACTGACAACCCCTACTACTTGGGAAAAAGCCTGTTCTACATGCACCAGGTGCCAGTGCAGGA<br>TTTCACTATCGAGCTCCTGAGCCAGTCCGACTATTCACTGGGCTACAGCCTTAACAACATGAGCCTCGCTTG<br>CTACGCCAAAATGGGAGGAGTGCCCTGGCTGCTCAAGTCCTCTCCCACCCTTAGCCACGAGCTGGTGATCGG<br>CATCGGCAGCGCCAACATTGTCCAGGAGAGGGGGCACACAACCAGAGGATCATGGGGATAACCACCGTATT<br>TAGTGGCGATGGCAGCTACATCGTCAGCAGCACGTCCAAAGCTGTGGTTCCCGAAGCATACTGCGAGGCGCT<br>GACTAGCGTGCTGGGCGAGAATATCGAAAAAATCCAAAGGAGAATGAATTGGCAAAAGGGTGACTCAATCCG<br>ACTGATCTTCCACGCCCAAGTGAAGAAGTTCAACAAGGAGGAGATTCAGGCAGTGCGAGCCGTGATAGACAA<br>GTATAGGGACTACCAGATCGAGTACGCTTTTGTGAAAATCAGCGAGAACCACGGCCTGCACATGTTTGACAG<br>CTCAACCGCCACCATGCCCAAGGGCAGGTTGGCCACACACAGGGGTAAGACCTTTAAGCTGTCCAAAAACGA<br>GATGTTGGTCTACCTGATCGGACAGAGGGAGCTGAGACAGGAAACCGACGGCCACCCCAGGGGTGTCATCGT<br>GAACGTACACAAGGACAGCACTTTCAAAGATATCAAGTACCTGAGCGCCCAACTGTACTCTTTTGCGAGTCA<br>TTCTTGGAGGTCATACTTCCCCAACCCTATGCCCGTGACCATCACCTACAGCGACCTTATCGCCCACAACCT<br>CGGCTGGCTGAACCAGCTGCCCGGGTGGTCTGACAGCGTAATGATAGGTAAAATCGGTCATAGCCAGTGGTT<br>TCTGTAGTAACTCGAGGTTAACTTGT |
| 260 | 92 (Helicase) | GGTGTCGTGAGGATCCATGCCGAAAAAGAAAGGAAGGTTGAGGATCCTAAAAAAAAAGAAAGGTCGGCAG<br>CGGGTCTATGTTCGACATTGGATCAATGGTGAGAGTTAGGGGTCGAGACTGGGTCGTGTTGCCTGGCAGTTC<br>CGCAGACTTTCTCCTGCTTAAGCCACTCGGCGGATCAGATGCAGAAAGCACAGGGGTTTATGCCGGTCCCGG<br>CGGCGAAGTTGTGAGATCAGCGACTTTTGCGCCACCCGATCCGCAAGCGTTTGGAACAGCCTCTGGCGCTCG<br>GCTTCTCCTGAATGCAGCTAGATTGGCCGTTAGGTCCGGCGCTGGACCGTTCCGCTCCCTTGGCAGGCTGGG<br>GGTAGAACCACGCCCATATCAACTTGTCCCCCTCCTTATGGCCCTGAGACAAAGTACCGCCCGGCTCCTTAT<br>TGCCGACGATGTAGGCTATAGGAAAGACAGTTGAAGCGGCACTCATCGCCAGGGAGCTGCTTGACCGCGGAGA<br>GATAGAGCGATTCGCTGTGCTTTGTCCGCCCCATCTGGCTGGTCAGTGGGTAGGTGAGCTGAGGAGCAAGTT |

TABLE 19-continued

Argonaute nucleic acid sequences containing 2 nuclear localization sequences and a cloning sequence

| SEQ ID NO | Argonaute | Sequence |
|---|---|---|
| | | TGGGATAGATGCCGTCGCGGTCCTCCCCGGAACCGCGCGAAGACTGGAGCGCGGCTGTAACCCAGGCCAATC<br>TGTGTTCGCCAGATACCCTTTCGCAGTTGTCTCTCTCGACTTGGTCAAATCAGACCGATGGCGCCAGGATTT<br>TTTGCAGAACGCCCCCGAGTTTGTTATCGTCGACGAAGCGCACGCCAGTGCTGAGGGCGAGGGGTTGGGCGC<br>GCGAAGACATCAGAGATATCGCCTTTTGGAGGACCTTGCGCGAGACCCAGAGCGACACTTGATACTCGTGAC<br>AGCTACGCCACACAGCGGAAAGGAGGACGCATTCAGATCCCTTTTGAGATTGCTCAACCCTGAATTCGCCGC<br>TCTGCCACTGGATCTCTCCGGCGCTCAAAACGAAAGAGCTCGGGCAGCTATCGCTCGACACTTGGTGCAGCG<br>GAGGAGGGGTGACATCACTGCATACCTTCACGAGGACACCCCATTTCCAGTCCGAAGGGACGCCGAGGTTAA<br>GTATACTCTGCACCCCGATTATGCGGCATTGTTCGAGGACGTTCTGGCCTATGCAAGGGAGTCCGTGCACGT<br>TCCAGGCGAGGCGCATAGTCGGACGCGGATACGCTGGTGGGCCGCCCTGGGACTGCTTCGGGCTTTGGCTTC<br>TTCACCCCAAGCAGCCGCAGCCACTCTCCGGGAAAGAGCAAGCACCGAAGGCGAGACTGATGAAGCAGTTAT<br>TGAAAGACTTGGCAGGGAACTGGTGCTTGACCCCGAAGACGGTGAACATGGGCTGCTGGACGTCACCCCTGG<br>AGCGCAGGTCGACGGTGAAGAAAGCGGGACCACGCGACGCCTTCTCGCACTCGCAGAGAGGGCCGACGCTCT<br>GGCTGGGGCAAAGACCGGAAGCTCGCACTCCTGACCGCACAGGTCAGGGATCTTCTGCAGGAAGGTTTCGC<br>GCCGATAGTTTTTTGTAGGTTCATTGCGACCGCGGAGGCAGTAGCGGAGCACTTGAGGGGAGTTCTGAAAGG<br>AGCTGAAGTCGTGGCTGTCACAGGAAGGCTGACGCCAGATGAGCGCGTCGCCCGCATCGAAGAGCTTGCACC<br>CCACGAGCGACGGGTTCTTGTGGCAACGGACTGCCTTAGTGAGGGCATTAATCTCCAAGCTGCCTTCAGCGC<br>AGTAGTACACTATGATCTCCCCTGGAACCCTACCAGGCTCGATCAAAGGGAGGGCCGAATTGACCGATATGG<br>TCAACGATCACCAGAGGTCCGAGTGCTTACATTGTATGGGGAGGATAACAGGATAGATACTCTGATACTGGA<br>TGTTTTGATCCGAAAGCATCGGCTGATCCGGGCTACCTTGGGAATGGGTGTCCCCGCTCCCGACGAGGCAGA<br>AGGATTGCTTGACGTGCTGTTGGCGCGAGTACTGGAACCCGAACGAAGAGGTTCTATTCAGCCATTGCTTCT<br>GGATGAAGTGCAGGCTTTTGATTTGAAATGGCGCGATGCGGCTGAAAACGAAAAAAGGTCAAGGTCACGATT<br>CGCCCAGAACTCTATAAGGCCCGAAGAAGTAGCAGGGGAACTCGCAGCGGTACGGGAAGCGCTCGGAGACGC<br>TCGAGCCGCTCAGGACTTCGTTCTTGATGCACTGCGAGGGGCCGGTGTTCAGGTGACGCCGCGCCCCGACGG<br>AAGCTTCGAAGCGGACCCCACCCAAGCCGATGTAGCACCGGAGGTCCGCGACTTTCTGCGGGGAGCAAGGCG<br>CTTCAGATTTGACGCACGGGTAGAACGAGGTGTGACGCCCTTGGCGCGGAACCACCCATTGGTCGAGCAACT<br>TGCAAGCACTGTACTGGGTCAGGCTCTGGAGTCTCCGCAGGAGGCCGCAGCCAAGCGCGTAGGCGTCATTCG<br>GACCTCTGGCGTAAGTACTCAGACCACTCTTTTGCTCCTTCGATGGAGATTTCATCTTTCCGGACGAAAGGG<br>AAACCGATCTTGGCAAACTCTTGCTGAAGAACTTGATCTTCTGGCTTACGCAGGAAGGGCAGAGGATCCGCA<br>GTGGTTGGACGCTGAGGCCACCAGAGCTTTGCTCGATCTGACCCCTCAGGGTAACTTGGATCCGGTGCAGAA<br>AGAGGAACGCCTTACTCGGACGCTTGAGGGACTTAGCGCTTTGGAGGGGGTTTTGGACCAGCGAGGAAGGGA<br>TAGAGCCGCAGCTCTGCTTGACGCTCACGAGAGAGTACGGGGAGCAGCGCGAGGGCAAGGGGTGACCTATTC<br>TGCCGAGCCTCCTGGCCCCCCGGATCTGCTTGGTGTCTATCTCTTTCTCCCCGCACCAAGACTCGGAGGCCT<br>CGCCTAGTAACTCGAGGTTAACTTGT |
| 261 | 71 | GGTGTCGTGAGGATCCATGCCGAAAAAGAAACGGAAGGTGGAGGATCCAAAGAAAAAACGCAAAGTTGGCAG<br>CGGCAGCATGATAGCCGTGGAAGAGTGGCAACCTGCCGACGGACTGACCCTTGAGCCTAATGCAAAGAGGGC<br>TGCGAAGGCTAGAAAGAGGTGCCTGGCCCTGACAGCGGGTCCCGGTGCCGAAAGACAGAGATGCTCGCACA<br>ACGCGCCGACTTCTTGTTGAGGACCGGAACCTGTCGGTACCCCAAGAGGATACTGGCCATCTCATTCAAAGT<br>GGATGCAAGTAGAAACCTGAAGGACAGAGTGGAGAGGAGGTGCGGCTATGATTTGGCGTCAAGGTTTGACAG<br>TTATACTTTCCACGCGTTCGCCAAAAGGATCATCGACCGCTTTAGGCCGGTGCTGACAGGCAAGGACGCCCT<br>CGACGCAGGCTACACCATCGTGGATAAGAAGAATGGCCCCTCTAGGACCCAGATCGAGTTCGGCGACCTTGT<br>CCCCCTTGCCATACAAATCCTGCAATCAAGCAAAATTGCACGAAACGCGATCCGCCAAACTTACAGCGACAT<br>CTTCCTGGATGAGTTTCAGGACTGTACAAACCTGCAGTACGACTTGGTAAAACTTGCGTTCCAGGGTACGTC<br>AATACGGCTGACGGCTGTTGGCGATACAAGCAGAAGATAATGGCCTGGGCTGGAGCCCTGGACGGCATTTT<br>CCAGACGTTTGCCAACGATTTCAACGCCGTGTCCCTGAACATGTATAGGAATTTCAGAAGCAAGCCACAACT<br>GCTCAGGGTTCAAAATGAAATTATCAGGAAGTTGGACCCCGATTCCGTGATGCCTGACGAACAACTTGACGG<br>TGATGAAGGCGAGGTCTATGCGTGGAGGTTCGAGGATAGCTGCAAGGAAGCCGTGTATCTTGCGGACCTTAT<br>CAATGGCTGGATCAACACCGAACAGCTGCCCCCAGCGGAGATCGCCGTACTGGTCAGCAAACAGCTCGACCT<br>CTATGTCGACCACTTGATGACTGAGCTCGAGGCTCGGGGAATCCCCTACAGGAACGAGCAGCAGCTTCAAGA<br>CATCACCATAGAGCCGGCAGCTAGACTCATTGTGGACTACTTGAGTTGCCTCTACGGCAAGAGAGAGCCGAA<br>AGCATGGATCCGGCTCATGAACCAGCTGATCCCATTCGCGGACGAGGAGATCCAATCTAGTGCTCGAAAGGA<br>CCTCGACCAGTTGATAAAGAAGCAGAGAAAAAGGGTGAGCGACGCGAAGCACACCGATTCACCTTTCAGCGA<br>TTGGGCACAACTCGCAATTGAATTCCTGAAGTACATAGGCAGTAAGATGCTGGTGGCACTGAGTCCAGATTA<br>CGAGACGCGCGAGAGGCTGAATGACGTGATCAGGGAAACTTTCGCGAGGATCAAGGAACTGTTGAAGAGCGA<br>GCCCGACCTGCCCAAGGCGCTGGGCCGGTTTGCCGATGACCAGGCGGTGCGAATACTGACCATCCACAAGAG<br>CAAGGGCCTGGAATTCGACAGTGTGATCATCATGGCCGTCGAGAACGAGATATTCTTCGGGAACCAGGACGA<br>GAATAGGTGCGCTTTCTTCGTAGGTGTGAGCCGAGCAAAAAGGAGGTTGATACTTACCCACGCCGACCAGAG<br>GGAAAGGCCAGCGTCTGCCAAGCGATGGAATGTTAGTAGAACCGCTCAGACTGAGTACATTAGTTACGTCAC<br>CCCTTTCGTGAGGCCACAGTAGTAACTCGAGGTTAACTTGT |
| 262 | 21 | GGTGTCGTGAGGATCCATGCCGAAAAAGAAAAGGAAAGTGGAGGACCCCAAAAAAAAGCGGAAGGTCGGGAG<br>TGGCTCCGTGGCCGCTTTGAAGCGCTACTTTAATGACAAGAACCTGATCGTGATAGGCTACTCTGGCAGGGA<br>CAAGAGCCTGATGAGTGCGCTTACCGAGGCTTTCTCTGAGAAGGGCTCTGGCCGCATCTACTGGTGCGGCTA<br>CGGCAGCCACATTTCCCCCGAGGTGGAAAGCTTGTTGAGGACCGCGCGAGAGGCAAACCGCGACGCCTACTA<br>TATCGCACACCGATGGGTTCGACAAAACCATGTTCAGCCTGGTAATAAACTGCTTCCAGGCGGATATCGAAAA<br>GAAGAAAGAGATAATGAGCATCCTGGAGTCTGCTCCCGAGGACAACGATACCAGCCCGTTCTCAATTCACAT<br>CACCAGGACGGATAAAATACCTTAAGTCCAACCTCTACCCGATCATCTTTCCTAAGGAGCTGTTTCAGTTTGA<br>GATAGAATATCATGAGGGCGAACGACCATGGACCCTGCTGAGAGAGATCACCAAAGACCAGAACATCATCGC<br>CGTGCCCTACAAGCAAAAAGTCTACGCCTTGTCAACGGGATCGAGCTATCAACAACGTGTTTGGTAGCCGGTT<br>GAAATCAGATATAGAGAGGATTCCCGTGTCTATGGATGACATTGAGCGCAAGTCTAGTTACAGGGAGCTCTT<br>CCTGAGGGCCACCCTTCAGTCTATAGCCATTATAAGGGGCCTGAACGTGGACATACGACACAATACCCTTTG<br>GCGGAGCGACATCTTTAGGAACGACAATGGCACCCTCATCCACGAAGCGATCGAGTGTTCCCTGGTGTTTGT<br>GCCCCAACAGAAGTATGCCCTGTTGAGCTTGAGGCCCACCATCTACATAGAGAACTCTCATACGGTTAGCAA<br>GGAGAAAAAGCAGGAGTACGCCAGGATCTACCTGGATAAGATGTGGAATAAAGCGTACAGCACGAAGTTGGC |

TABLE 19-continued

Argonaute nucleic acid sequences containing 2 nuclear localization sequences and a cloning sequence

| SEQ ID NO | Argonaute | Sequence |
|---|---|---|
|  |  | CCAGTGGGAATCTATAATCTTTGGAGACACGAGGCTCGCCTTCGAGGTGCCGCAAAATTCAGGATCCGGGTT<br>TAAGTTTCTGATAAGCCACAACTGCGGCTTCAGCGAAATCCAGTATCAAGACAACACCGAAAGGGGATACAG<br>TAGCAAGAGCTACGACAACAAGAGGACGATCTATAGGGGCTTGCAGCTGAAGGAACCCGAGCTGGAATTTGT<br>CAATACGTTTGCAGACCGGCCCTTCCTGGACAGCAACCCCATGCGAGGCCTGAGCAATCACAGGCCGTACGA<br>CAGCTGGCAGAAAGACGTTCTCTTGCAGAACGTGCGGTTGGGCGTGATTTGCCCGAACACGCACACCGACCG<br>ATTCCACTCTTTTCTGCAGCAGCTTAACACCACAATTCAAGCCAATGACGATAGCGACTACATTCAGTCCTA<br>CACCGGTTTCCATAGCATTTACAAGACTCTGCTGGAAATCCCCGATAACGGGACCGACAAATGGATAAACAT<br>CGAGGATACCCCCAAGGACACCATCAGTCTGGTTCAGAGTATATGTCACCAAGCGAACCGACTGGCCGACAA<br>GTACCCGGGCATCGTGGTGGTGATTTTCATCCCCGCATTTTGGTCTATCCATCGACAGTTCAAACACAACGG<br>GGAGAGCTTCGATTTGCACAACTACATCAAGGCCTACGCCGCACAACATAGCTTCACTACCCAAATCATTGA<br>GGAAAAGACGCTGCGCGACCACATGGTCTGCGAAATTTGTTGGTGGCTGTCACTCGCACTGTTCGTTAAGGC<br>TATGCGAATCCCGTGGGCACTGGCCAATTTGGACTCTGACACCGCTTACGCGGGTATAGGGTACTCAGTGAA<br>GACCAACAGCAAAGGCAACGTCGACATAGTGCTTGGATGTTCACATATATACAACGCAAAGGGCCAGGGTCT<br>CAGATACAAACTCTCTAAGGTCGAGCAGCCCCAATTCGATGGCAAGAAAAATCCTTACCTTACGTATGAAGA<br>GGCCTTCAAGTTTGGAATTACCATACGCGAGTTGTTCGTCAAAAGTATGGACCGGCTTCCCAGGAGGGTTGT<br>GATTCACAAGCGGACGCCGTTCAAAAAGGAGGAAATAGAGGGAATCACTCACGCGTTGACTCAGGCTGGCAT<br>TAAGGACATCGATCTCATTACGATCAATTACGAGTACGACGCCAAGTTCATAGCGCAGAAGGTATACTATGA<br>CAACATCAGCGACGATTCATATCCCGTAAGTAGGGGCACCTGCATCAAATTGTCCAGCCGAAATGCGCTGCT<br>GTGGACACACGGCGTGGTTCCCTCAATCCGGGAGAGACGACGCTACTACCCCGGTGGGCGCTGTATTCCCGC<br>ACCCCTGAAGATAACAAAATACTACGGTAAAGGCGATCTTCCGACAATCGCCAGCGAGATTATTGGATTTAC<br>TAAGATGAATTGGAACAGTTTTAATCTGTACACGAAACTGCCCGCCACCATAGATACGAGCAATACATTGGC<br>GCAGGTCGGCAATCTGTTGCATCAGTATAACGGCGCAACTTACGACTACCGATATTTCATCTAGTAACTCGA<br>GGTTAACTTGT |
| 263 | 63 | GGTGTCGTGAGGATCCATGCCCAAAAAGAAGAGAAAGGTAGAGGATCCCAAGAAGAAACGAAAAGTAGGCAG<br>CGGCAGTATGGTCGCGCTGAGGCTGAACGGCGTACCCATCTTGTGCGCCGCTGACGTAACCGTGGCCGTGGC<br>GAAGTTGCCGTACACGAAGGAGAGCCTGGACGAGTTGAGGAAGGAGCATGCGGGGAGGTATTGATTAGGAG<br>AGGCGGAGATGACGGGCAGGAAATCATGTCTGTTCCCTTGCTTGCTGATGCTCCGCAGCTGAGCGATGCCGT<br>TGTGGAAGTTAAGCTGTCAGAAGCCCACTGGTTGCTCGCCTCACTCGCGGTGGAGGCCCTCACCAGGTTGTT<br>CACAGAACTTGGTAGACCTATCCTGCGGTCCCGGCCATTGCGGCTGCTCTCCCAAAAGCCGGCCAATCTTTT<br>TCCGGAGAACGTCGGACTGCCAGACTGGCTGCAAAGGAGGGTTGTGCTGGATTTGGAGACTAGGAAGATCTG<br>GCGGCAGGATGGAGACCCGACATTGGTGCTGCTGTGCGATGTGCGGACTCAAAACTTTATCGACGTGCCAAC<br>GGATAAACTGATGGCCACCGGCGTAAGCGTTATGGGTCGCTACGTTAGCCGAATGGTGAGCTCTGATGATCC<br>CCGGATCACCTCACATCTGAAGCTCGCCGGCAGGGTCATTAGCATAGAGGGCGACCGACTGCTCCTCGCCGA<br>CTTTGGCGAGGGACCGGATAGTATAAGCATTGCTCATGCCTATCTGGAGAGACGACGGGAAAATGTCGACTG<br>GTGTGTTCAACAGCTGAACCCCGCGAAAGCAGGGCAAATCCTGATGAGCGTGCAGGCCGAGGCTGCGAAATT<br>CTTGAACGGACCTGGCCGATTCGAGCTGATCAAGAGGACATTCGATTACCTGCGCACGCAGAGTATAGAGCT<br>TGTGCCCGACGTGAAGCTGGAGTTGGGGGACTTGATTGGCATGGGAGCCGCACGCTGGCCCTTCCGCCAGGA<br>AACAATTAAGAAGCCTACCCTGGTGTTTGATCCGTCTGGTGTCAAGACCGATACCTGGAACGAGCGAGGGCT<br>TGACAAACACGGACCCTACGACCAGAGGACCTTCAGCCCCAAGGAAATGAGGATCGCCGTTATCTGCAGGGA<br>AGCAGACGAAGGTCGGGTTGAAGGATTTCTGGCCAAGTTTCTGGACGGGATGCCACACGTTATCGTCGGGGA<br>GAACCGAAAACCCTATGAAAAGGGATTCATAAGGAGGTTCGCCCTGAGTGCCCCGAAGGTGCACACTTTCAC<br>CGCTAAGTCTTCTAGTGTGCCGGACTACCTGAATGCGTGCCGAGCGGCCCTGAAGTTTGCCCACGACCAAGG<br>CTTTGAATGGAGCTTGGCAATCGCGCAAATCGGACAAGGACTTTCGGGAACTCCTCGGTCCTGACAATCCCTA<br>CTTCGCGATCAAGGCCGCGTTTCTCAAGCAGAGGGTGCCCATCCAGGAGTTGACGCTCGAGACAATGAGCAC<br>CCCCGACAGGCAGCTGGTGTACATTTTGAATAACATAAGCCTCGCAAGCTACGCCAAGATCGGCGGCATTCC<br>GTGGCTGCTTAAGAGCGGTCCTACCGTGGGCCACGAGCTGGTCATTGGTATTGGTAGCCAGACCGTTAGCAG<br>TAGTCGATTGGGCGAGAAGCAACGGGTGGTGGGCATTACCACCGTATTCACCCACGATGGCAGATACCTTTT<br>GGACGACAGGACGCGAGCCGTGCCATACGGCGAGTACGAAGCAGCTTTGTCCGAGACGCTGACCAGGGCCAT<br>AGAGAGGGTAAGGACGGAAGATAACTGGAGGTCAACCGACGCGGTGCGACTTGTATTCCACGTGTTCCAGCA<br>AATCAAAGACTACGAGGCCGACGCAGTGGGGAAACTGGTCGAGAATCTCGGCTTCAGCGATGTCAAGTACGC<br>CTTTGTGCATGTCGTTGACAGCCACCCCTACACCCTGTTTGACGAACACATGCCAGGCGTTAAGTTTGGCTA<br>CGAGATGAAGGGCGCCTACGCACCTGAGAGAGGCCTGTGCATCAGTCTTGGCAGGGACGAACGCCTCCTCAG<br>CTTTTACCGGGTCTAGGGAGGTTAAACAAACCCATCATGGCCTCCCAAGGCCAACCCTTCTTCGACTGCATAG<br>GAACAGTACCTTCCGGGACATGACCTACATCGCCAGGCAGGCTTTCGACTTCGCAAACCACTCATGGAGGAT<br>GCTCACCCCAGCGCCCCTCCCCATCACCATCCACTACGCCGAACTCATCGCCCGGTTGTTGGCTGGTCTGAA<br>AGACACACCCGGCTGGGACGAGGACACAATGCTCGGCCCAGTAGGTAGAACCCGATGGTTTCTGTAGTAACT<br>CGAGGTTAACTTGT |
| 264 | 33 | GGTGTCGTGAGGATCCATGCCAAAGAAAAAACGGAAGGTCGAGGATCCCAAAAAAAGAGAAAAGTCGGTAG<br>CGGCAGCATGAACTACACAGCCGCCAACACGGCCAACAGCCCATTGTTTCTCAGCGAGATTAGCAGCCTTAC<br>CTTGAAAAACAGCTGCCTCAACTGCTTCAAACTGAATTACCAGCTGACTCGCGAAATAGGCAATAGGTTCGG<br>CTGGCAGTTCAGTAGGAAGTTCCCTAACGTTGTGGTGGTGTTCGAGGACAACTGTTTCTGGGTTCTCGCTAA<br>AGATGAGAAGAGCTTGCCCTCTCCTCAACAGTGGAAGGAGGCTCTGAGCGACATCCAGGAAGTGCTGCGAGA<br>GGATATCGGAGACCACTACTACAGCATCCACTGGCTTAAAGACTTCCAGATCACCGCCTTGGTGACCGCCCA<br>GCTCGCCGTGCGAATTCTGAAAATCTTCGGTAAATTCAGCTACCCCATCGTGTTCCCCAAGGACAGTGAAAT<br>TAGTGAGAATCAAGTGCAAGTAAGGCGAGAAGTCAACTTCTGGGCCGAGATCATTAACGATACCGACCCCGC<br>CATTTGCCTCACCATCGAAAGCAGCATCGTCTATTCCGGCGATCTCGAGCAGTTCTACGAAAATCACCCGTA<br>CAGGCAAGCACGCCGTGAAGCTGCTGGTGGGCCTGAAAGTTAAGCAATTGAGACCAACGGCCACGCTAAGAT<br>CATCAAAATCGCTGGCACTATAGGGGAAAAGCGCGAATACCTGTTGACTAAGGCACGGGAAGCATATCCCG<br>GCGAAAGTTGGAGGAAGCCCACCTCGCACAACCCGTGGTTGCGGTGCAGTTTGGTAAAACCCTCAGGAGTA<br>CATATACCCCCTGGCTGCCCTCAAACCTTGCATGACCGACAAGGATGAGAGCCTGTTCCAGGTCAATTACGG<br>CGACCTCCTGAAGAAAACCAAGATCTTCTACGCTGAACGACAGAAATTGCTTAAACTGTACAAGCAGGAGGC<br>GCAGAAGACTTTGAATAACTTCGGTTTTCAGCTTCGGGAAAGGTCCATCAATAGCAGGGAAAATCCAGACTT |

TABLE 19-continued

Argonaute nucleic acid sequences containing 2 nuclear localization sequences and a cloning sequence

| SEQ ID NO | Argonaute | Sequence |
|---|---|---|
| | | CTTCTGGACGCCCCCAATTTCATTGGAGCAGACCCCCATCCTGTTTGGGAAGGGTGAGCGCGGTGAAAAGAG GGAGACCCTCAAGGGCCTTTCAAAGGGCGGAGTCTACAAAAGGCACAGGGAGTACGTTGATCCTGCCAGGAA AATTAGGCTGGCCATCCTTAAACCGGACTCTTTTAAAGTGGGCGACTTCAGGGAGCAGCTGGAGAAGCGACT CAAGCTGTATAAGTTCGAGACGATTCTCCCCCCTGAGAACCAAATCAATTTTTCTGTGGAGGGTGTTGGGAG CGAAAAAAGGGCCCGACTGGAAGAAGCCGTAGACCAGTTGATAGGTGGCGAGATCCCCGTGGACATCGCCCT CGTCTTTCTGCCCCAGGAGGACCGGAACGCGGACAACACCGAGGAAGGCTCCTTGTATAGCTGGATCAAAAA GAAATTCTTGGATCGGGGGTGATAACACAGATGATATATGAGAAAACTCTCAACAATAAGAGCAACTACAA TAACATCCTGCACCAGGTGGTTCCCGGCATATTGGCAAAGCTCGGAAACCTGCCGTATGTGCTGGCCGAGCC TCTTGAAATCGCCGACTACTTCATCGGCCTGGACGTCGGAAGGATGCCTAAGAAGAATCTCCCTGGTTCACT GAACGTGTGCGCGTCCGTTAGGCTCTACGGAAAGCAAGGTGAATTCGTCCGATGTAGAGTCGAAGATAGCTT GACCGAGGGGGAGGAAATCCCCCAAAGGATTCTTGAGAATTGTCTGCCGCAGGCAGAACTTAAGAACCAGAC CGTCCTGATCTACAGGGACGGGAAATTCCAGGGTAAGGAGGTGGAAAAACCTTTTGGCTCGGGCACGAGCCAT CAACGCCAAGTTCATCCTGGTAGAGTGCTACAAGACCGGCAGCCCGAGACTTTACAATTTCGAACAAAAGCA GATTAATAGCCCCAGCAAGGGGCTGGCGCTTGCATTGAGCAACCGGGAGGTCATCCTCATCACCAGCCACGT TAGCGACACAGATCGGCGTGCCTCGGCCTCTCCGCCTGAAGGTGCACGAACTGGGAGAACAGGTGAACCTCA GCAACTTGTGGACACGACCCTGAAACTGACTCTGCTGCATTATGGCTCTCTGAAGGAACCTCGGCTTCCAAT CCCCTTGTACGGAGCCGACGCCATCGCGTATAGGAGGTTGCAAGGAATCTATCCAAGCCTGCTGGAGGACGA CTGTCAGTTCTGGTTGTAGTAACTCGAGGTTAACTTGT |
| 265 | 19 | GGTGTCGTGAGGATCCATGCCGAAAAAAAAGCGCAAGGTGGAGGATCCAAAAAAGAAACGGAAAGTGGGATC TGGCTCCATGAACTACACAGAGGCCAAGACCGCCAATAGCCCCTTGTTCCTTAGCGAGATTAGTAGTTTGAC ACTTAAGAATAGCTGCCTGAATTGTTTTAAGCTGAACCATCAGGTCACCCGGAAAATAGGCAACAGGTTCTC TTGGCAGTTCAGCCACAAGTTCCCTGACGTCGTGGTAGTGTTCGAGGACAATTGCTTTTGGGTGCTGGCTAA AGATGAAAAGAGTTTGCCTAGTCCACAGCAGTGGAAGGAAGCACTGTCAGACATACAGGAAGTGCTGAGGGA AGACATTGGGGACCACTACTACAGCATTCACTGGTTGAAAGACTTCCAGATAACCGCCCTGGTCACCGCGCA GCTGGCTGTGCGGATTTTGAAGATATTTGGGAAGTTTAGCTACCCGATCGTGTTCCCCAAGGACAGTCAGAT CTCTGAAAACCAGGTGCAGGTGCGAAGGGAAGTGGATTTCTGGGCTGAGATAATCAACGACACGGACCCAGC AATATGCCTGACGGTGGAAAGCAGCATCGTTTACTCTGGCGACTTGGAACAGTTTTACGAAAATCATCCGTA CCGACAGGACGCCGTGAAACTTCTCGTAGGGCTGAAAGTGAAAACTATCGAAACCAACGGCATCGCGAAGAT TATCAAAATTGCCGGGACCATCGGAGAAAAGCGGGAGGAACTGCTGACCAAGGCAACCGGGTCCATAAGCAG GCGCAAATTGGAGGAGGCACACTGGGCCAACCTGTGGTGGCCGTGCAGTTCGGCAAGAATCCGAGAGAATA CATCTATCCCCTTGCCGCGCTCAAACCGTGTATGACCGACAAAGACGAGAGCCTGTTTCAAGTGAACTATGG CGAGCTTCTGAAGAAGACTAAGATTTTCTACGCCGAACGGCAGGAGTTGCTGAAATTGTATAAACAGGAGGC GCAGAAGACGCTGAACAACTTCGGCTTCCAGCTCCGGGAGCGGTCAATCAATAGCAGGGAGAACCCCGACTT TTTCTGGACCCCCTCAATTTCCCTTGAACAAACGCCCATCTTGTTTGGCAAAGGTGAGCGAGGTGAGAAACG AGAGACCTTGAAAGGCTTGAGCAAAGGCGGCGTGTACAAGAGACATAGGGAGTACGTCGACCCCGCGAGAAA GATTAGGCTGGCCATCCTGAAGCCGGCCAATCTCAAGGTTGGGGATTTTAGGGAGCAGCTCGAGAAGCGACT GAAGCTCTATAAGTTCGAGACCATCCTTCCCCCCGAGAATCAAATCAATTTTAGCGTAGAGGGCGTGGGCTA TGAAAAACGAGCCCGCTTGAAGAGGCCGTGGACCAACTGATTAGGGGGGAGATACCCGTGGATATCGCTCT TGTCTTTCTTCCGCAGGAGGACCGAAACGCCGACAACACCGAGGAGGGGAGCCTTTACTCATGGATCAAGAA GAAGTTCCTTGACAGGGTTGTGATAACGCAAATGATCTATGAGAAAACGCTTAACTATAAGAACAATTACAA GACATCCTCGATCAGGTGGTGCCTGGAATCCTTGCGAAACTTGGTAATCTGCCTTACGTGCTCGCAGAGCC ACTGGAAATCGCCGACTACTTCATTGGCCTGGATGTGGGTCGCATGCCTAAGAAAAACCTCCCCGGGTCACT TAACGTGTGCGCGTCCGTAAGGTTGTACGGGAAGCAGGGCGAGTTTGTGCGGTGCCGAGTCGAAGATAGTCT CACCGAAGGTGAAGAGATCCCCCAGAGAATCCTGGAGAATTGTCTGCCCCAAGCCGAGTTGAAGAACCAGAC CGTGCTGATATACAGGGACGGTAAGTTCCAGGGCAAGGAGGTGGATAACTTGCTGGCCCGAGCCAGGGCCAT TAAGAGCAAATTCATACTTGTCGAATGCTATAAAACGGGCATCCCCAGACTGTATAACTTCAAGCAAAAACA GATCGACGCCCAGTAAGGGCCTGGCGTTCGCTCTGAGTAACAGGGAGGTGATCCTGATCACGTCCCAGGT TAGCGAAAAGATCGGCGTGCCGCGACCTCTGAGGCTTAAGGTACATGAGCTGGGAGAGCAGGTAAATCTGAA GCAACTGGTGGACACCACACTCAAGCTGACCCTGCTCCACTATGGGTCTCTTAAGGACCCGAGGCTGCCCAT CCCCCTTTACGGCGCTGACATCATCGCGTATAGGAGGTTGCAGGGAATATATCCCTCTTTGCTGGAGGACGA TTGTCAGTTCTGGCTGTAGTAACTCGAGGTTAACTTGT |
| 266 | 85 | GGTGTCGTGAGGATCCATGCCTAAGAAGAAAAGAAAGGTGGAAGATCCAAAGAAAAAACGCAAGGTGGGTAG CGGCTCCATGACTAACAAAACCAAACAAAAAAGCAGGAAGCAGAGGTCCCTCATAGAATTTCTTAAGGTGAA GAAGATCAACAAGGAAGATGGTAAGAACCATAACCTGATCAAGTATAGCACCGAACGGATCGATACAGGAGT GACCCAGAGCCTCATTGACATCAATATATCCAGTAACATCCTTAAGCTGCGGGGCAGCATTGCTCAAGAGGT GTTCAAACGGAAAATTGGCGTTTACTACGGGCTTGGGAAGTATTACGTTGCCGAAAACAAGCTGAAGAACAC CGATCGAATGGATTTCTTGAAGAGGGTCTACGAGACCTTCCCCTATAACTACCTCGATAAACAGGACCCGCA CAGCAAGATCAGCTTTTACGAGTACTACACATTCCAGAAGTCCATCGACAAAGACGTGATAAACCTGCTTGA GCTGCAGAAGATAAACGAGTATAGTTGGGACATACTGGACCACACATCGCCACGCGCCTTCTCACAAGCTA TGTGAAGCTTTACTTGGGCGACTACTTGAAGCCAATCCTGTCCTCTTTCGAGTACGTCCGGGCTCGAATCAA GACAAAGCAAAAGACCGTTCCAATCAAAATCCCCGTGACCAAGAAGTTCGAGATCCGAACTTTGGGGTACGA CCCGACGCAGAGCGAAATTACTCTCGCCATAAAACGACACGCCAGCATGAACGCTGTGCTGTTGAGCAGCTT TCCCCCCGACATCCTCGCGGTTGTGATAACTAAGCTCAAACGCCTCGTGAACGAGGCCGTGAAGCAAGACTA CCGAAAGGTCAGATATACTCCGAGACCCAGCCGGGGAGCGGTACTGCCGCAGTTGTTGAAATCATCAGCGG CAGCCAAAACGTGATGAAGTTTCTCGAAGAGCATCCGAAGGGGGCCATCCACGTTGAAAAGCGACTTAAAGA GCTGGGTAAATCACTGCAGGAGGTCCGGTACCTTCTTATCGGCGTCTATGACAACAACGTCAGCCTGGAGCG GGCAAAAAAAGACGAAAGATACCACTACTTCACCGAGCATAACCTTACCTTGTACTTACGCCCGAGGT GCAAAAGGCGCTCTTTGGCAAGTTGATCGACGACTGGAAGACAAGCATTCTGAATGAGTACCAAAATAAGCT CCACGAGATCACGAGTCTTGGGATGTTAAGCATTTGGAGACCATACGGGGCATCCCGGTTTCCTTGAAAGA GAGGCTTGTGGTCCGCACCAGCGAGGGCTTGCAAACCGTAGATGACATTAGGGACATTTTGACCAACCCCAA GATTCTTAGTAATATGTTGCCTATATCCGAGGACGCGCTCAAGGAGACGCGAAAGCATAAACTGCGAATCAC CCTGTTCTGTCCGGAGAAGTTTAGTGAGAGGATTCACCGGACTATTTTCTACGACAAAATTGAACCAGTTTCG |

TABLE 19-continued

Argonaute nucleic acid sequences containing 2 nuclear localization sequences and a cloning sequence

| SEQ ID NO | Argonaute | Sequence |
|---|---|---|
| | | AGACGGTCTGCTTAGCAACAGCTTCGCAAGCGTGGACGAAATCGAATTGTTCCAGGTCAAAGGCGAAAACTC TAGCGATTATGAGGAGATCATGAAGGACGCTGGCCTTGATAAAATCCACGATTATACCCTGGCGGTCATCAT ATTTCCCGAACATTATAGTAAGCGCAACCTTGAGTTGCGCATCTTTTACAACTGGCTGAAAATGCGGTTCTA CTCAGAGAACAAGCCACTGGTTTTCCAGGGCGCTCGGATTGACAGCGTCTTCGGCCGGTATGCGAAGTACGC ATCATACAACCTCATCTTGCAGATCCCACCTAAATTGGGCATCTACCCGTACTCACTGGAGGAGCACGAGGA CTATGACTACATCATCGGCATTGATTACACCTATTGGTACGAGAGAGATACGCCTAGTCTGGGCGGTGGCGC CGTGTTGACCAGCCCGTCAGGGCTGATTGAGAGCATATACCCCATCGCACTCCCGAGCCGCACTGAATCCCT CAACATGTCCAAGATACTGAGCGAATGGTTCACGCGAACAGTCAAAACGAACCGGCATATCATAGATAAGGG CCACGTGACCGTGCTTATCTCCAGGGACGGCATGATTCCTAAGTACGAACGCCAGACAATCCAGGAGTTCCT GAGTGAATATAGCGGCGACATGGGCATGACCATAGAGGCAGTAGAAGTTAGGAAACGCATCGCCGTGAGGAC CTGGGCTACACAAGAGCCCGTGGCCTACTACAGCCCGATAAAGGTTGGCGACTGTACCTACTATCTGGTCGA CGCGCACACCGGATACCCGCTGGGGGAGAAAGGGAACCGAACCTTCTACAGCTCACCCTATCTCATAGGAAG TTTTTACAGGTTCGAAAAGGGCAAATCCTCCCCCGTGCCAGGTAGCGCAAAGAAGCACGTGATCGAAAGCCT GATAAGACTTCAAAAAATCAATTACGCCACCACCCGCATGGATAACATCAAGTTGCCCCTGCCCGTCGACAT CACCCACAAACTCATTAACTTTATCCGGGACACCAAGATGGAAATCAAGGGGGTCGGTATCCCAAACAGTCT CTTTATGATATAGTAACTCGAGGTTAACTTGT |
| 267 | 79 | GGTGTCGTGAGGATCCATGCCGAAAAAGAAACGGAAGGTAGAGGACCCCAAGAAAAAGCGGAAAGTTGGGAG TGGAAGCATGCCGTTCAATAGCAACCTGATCTTCGTGAAGCTCGACGACCTCAAGAGAGCCTTTCTCGAGGG CGTCCACAGTGGTCACGCCGTGGTGTATGAGGTGAGCGAGGGACTGAGCACCGAGGATCTGAAGAAAAGGCT TATCAAGGCCAGCGTGATGTACCACTATAGGTATGGAAGGAACGTGTTTGTCTTCGGCGTCAAGGAGGGCAC TAAGGTTGACGATCTTGTACCAGGCCGACGACTCGGCGAGCACGAGGTGAAGGAGGTTCTCAAGGGCATCCC GTCTAACAACCTGGTGTCCATGATGAGCGCCATGCTCAATTACCAGCTCTCTGTGCTTCTCACCAGCAAGGG CTTCCAGTATAGCTACGAAGAGATGCGGAGGGGCAAGTATCTGTGTGTCAGCAACTATTACGGCAAGCTGAT ACGGAACCCCGTGAAGGTTTGCCTCAAGGTAAATGTCATAAGGAGCCTCATTGACGAGCAGGATCAGTACCT GCCCATCGCGCTTAACTACAGGGTGAAGAAGAGCAGGCGGCTTAGCCCCGAAGTAATGAATGAGATCCACGC GGAGTTCATGGAGGCCTTCCCCAGCTACCTCAACGACCTGAAAATCATAACTCGCGTCTTGAACGACGATAT GGTGAGGAACAGGGAACTGAAATTCCTGGAGATCGAGTACAAACCCCTGCTATCATTACGTTCCGGTTTCG AGGCAACAGCACCGGCGAAAACGTGACCGACATTCTGAAGCTGGGCCCCTACTTCCTGCCTGGGGAGGAGGA GAAGATCGATGTGGTCTTTGTGTACGAAAATGCTCTCGCTAGCCAGGCGAAGAAACTCACCAAGGTTTTGGA GGATACCATCAAGGACGGGCTGGGCATAAAGCTGAACATAGACGACGAACATAAGTTCAGCCACGACAAGCC GCTGGGCGACGTTATTAAGCTGGTGCGCGACCGATTCATCAACAGCGGGAGTTGTCTGCTGGTCCTTAGCAA GGAGAACCGCCTCGGTCCTATCTTCATGAGCATTAAACCGCTCACGCTCAAGAAGAACTTCTACTTCAAGTC TCAATTTATCACCAACGAAACGATTAGCAAACTGGACTCTTATGCGGTCAAAGCCAATATCGTGAATAGCAT CCTGTTCAGGGTTGAAGGTACCCCGTACATGCCCGTTCTGCGGGGCAATATAGACGTACTGGCAAACAATTT GTTCGTGGGCATCGCCCTGAGTAAGCCTCTGAGGAAGGGCTACACCAAAGGAGGCATAGCCCTCATAGACCC CTACAGCGCCCGAATTATCACAAGGGCCATCGTGTTGAAGCCAAGATGAGGAGCGGCAAATTCGAAGCCTC AGACATGCACGAGATCGTGTCCAACATCAAAGGCGTGCTGAAGGACTACAAGGAGCTGTACAACGTCAACGA ACTTGTTATACATATCTCCAAGTTTCTGAGCGATGACGAATACGGCCTTTTTTACGAGTACTTGCAGGACCT TAATGTCAACGTGCGACTCCTGAGCATCAGGAAGAGGGACGCATTACACTGGTTAGGGACGGGAGGATGGA CAGCCTGACCATGATCAAGCGCGGCAAGAGTCATGTCGAGGTCATGTATTGGCCTCACGAAAGGGCCTACCA CCCCCTTACTATCAGGATCTACGGCGACAATGTGGACAGGGACGTGATGATGCGACACCTGAGGTTTATCGA GCTGCTCCGGCACATGTACTACCCGGCCAGCAGCCGCTTCATAGTTGAGCCCGCGACCATTAGCTACAGCAG GAGGGTCGCCAGATTTGCCCCCTGGCTTTCAGACAATACCTAGTAACTCGAGGTTAACTTGT |
| 268 | 84 | GGTGTCGTGAGGATCCATGCCCAAAAGAAGCGCAAGGTAGAAGACCCCAAAGAAGAAACGGAAAGTGGGAAG CGGCTCAATGGAAGTGTCCCCCTTCTTCAACGAACTGTTCAAGTACTACATATTTCTGTTTTTTGGTTTCAA GGTGAACATCGTGAAATCACATTACCAGAGCATTAAGAAGCACAAGATAATATTCTATTCCGGTGGGATCAT GGACGAGTATTACACTAACGCCTTCCCCATCAACAAATACTTTATCAACCGCATCATCTCTGAAAACTGCAT CCGCTGCCTGTGCAAAATAACCAAGCTCGAGAAAAAAGAGAAGATCGAGGAGTTGCTTTACTCTATCAGCGC CACCCTGGGGGGCATTTACATCGACGATTACAACCCAATGAAGAATAAGTTCAGCTTCTACATTTGGAAGGG AATCCTGAATAAGAAGATTAAATCCTACGGGTCTGAATGGCTCATTAACAAGATGAAAAACATGGGCTTTAA GGATCCGGAAAACAAGACGCTGTTGAACTATGTGAAAAAAAAGTACGAGAAAGACATAAAGTTCGACATCAT AAAGAAAGAGAAGATAGAATGGAGTAACCTCGACTGGGAGATAAAGGAAAAGATAGTGCTGGGCGCCATAAA AACTCACCCTACCATTCGCAAACTGATTGAATACAAGAATGAGAAATTCATTGACAAAATTGGAAAGAAAAT TCTGACTTACTTTAGCATCACAATCACCAGCGACGAGAACGAGAATTACTTTCTGATCGTCAAGCCCAAGCA TAAGATCATCAGCTCAGAGACAATTTACAACATGCTGAAGAACAACAAAATCGACTTTAAAACTCTTGAGAG GAAGCTGCTGAACGGCAGCGCCCTGATAACCACCAGTAGGGCAGTCGGCAGACGGAAATACGTCAAAATCAA AAAAATCATATCCCCAAGGAGAAGGAGTATTGGCAACATACCCAGGACATCAATGAGCACTACGAAAAGGA GGGCGTCCCGATCAGCGTCGGCGGTGACGACATCCACTGCTATATCTTCATCGGGGAAGACGATTACGCCTA CCACACGAAGAACTTCCTTGCTCTACGAGGGTGTGACGGGACGTGCAGAAAATACTCTTGGATATGGGTAA GTTCCTGGAGGAGCTGGAGACGGCAAAATCTATCCTCAAGCAGGGCAACCTCATAGACTTCAGTCGCGAATT CCTCAACATTAGCACGAAGGACGACTACACCCTTACTCTCCTGAGCACACTGTCCGATATCAAAGTGAAGCT TAAGACCGAGTCTGGTATCATCACAGGCGACTACCAGAAACTTAGGGAGATCTTTGACTGGATCTTCGACAA GAGCTTTAACCCCTTGAAGCCTAAGAATTGCTACCTTCCGCTGAGTATTCCCCCCATACTGAATGACAAGAA AAAGATCGGCGTGTACATCTTCTATAGCAATATTAGCGACCCCGAGCTTAGGTTTATCGAAGGGATCTTTAA GAAACTGGGCCTGATATGCGCCATCAATAAGAGTGTGCCAAAAATTGAGGTTAAACTCAAGAAGGAAGTGGA CTTTGAGGACTACGCCAACAGCAGGATCATAATCACCCAGACCGTACTGAGCAATCTCGAGGATGGCGAGCA GCCGTTCCTCATATGTATAAGTCCCTTGCTGCCGAATAACGAGTTCAAAGCCAAAATGCATCTGTTCTC TCACCCGCAGCTGATATTTCACCAATTCATGTATCCGTTCAACCTTCGAAAGTGCCTTGAGAAAGAATCATT CAAGAAACCCTTCATCAACTCAATCCTGTCTCAGTTCTTTCACAAAATGGGCATGTACCTCTTTAGTCTGTC TGACGAGCTGGGGAACTACGACTTCATTATTGGTTACGACATAAGTAGGGAAAAGGATGACATCGGGAAGAT AAAAGGTATCGGCGGCTCCGCGATCATCTACAACAATTACGGCCATGTCAAGTCAATCATAACGTTCGACGA CGTAGGGTCTAGCGAGATAGGCAGGTACGACCTCCTGTTCGCGCAGGTGCACAGCGAACTGATACCCCACCT |

TABLE 19-continued

Argonaute nucleic acid sequences containing 2 nuclear localization sequences and a cloning sequence

| SEQ ID NO | Argonaute | Sequence |
|---|---|---|
| | | GAATCTGAACAATAAGCGGAAAATTAAGATTCTGCTTCTCAAAGACGGGCGGATTTTCAAAAAGGAACTCGA<br>AAAGCTCAGCCAAATCAGCAAGAAGTATAACTTCGAGAGCACCTACATTGACGTTCGCAAGAGCACGCTGCT<br>CCGGTTCTGGGGTGTGCGGAGGGGCAAAGTGGTGCCCGAGTATAAGAATAGCTACGGGAAGTTCGGACGCGC<br>ATACTATATTAGTAGCCATTACTACAACCGCTTTTTCAAGCAACCAATCGCAATCGTGGAGAAGTACCACAT<br>AGACGAGGGCAATTACAAACGCGTGGAAATAGAGGAGAATGATATTAAGCAGCTGGTTCTGTTGACCAAGAT<br>TAACTACAGCCAACTGATGCCAGATAAGATGCGGCTGCCCGCACCCGTTCACTACGCACACAAGCACGTGAA<br>CGCCGTGCGACGGGGCTGGAAGATCAAGGACGTCTCTATACTGAGGAGCGGGTGTCTTCCTACGATCTAGTA<br>ACTCGAGGTTAACTTGT |
| 269 | 81 | GGTGTCGTGAGGATCCATGCCTAAGAAGAAACGGAAGGTGGAAGATCCAAAAAAGAAGCGAAAGGTTGGTAG<br>CGGCTCAATGGCCTATAGCCTTAACGCTTTCGAACTGGAAATTCCCGACATTGACGCCGACCTCTACAAAGT<br>TGACCCTCAACCCTCTGATGACCCATATCGAATCCTGGGGGGTTTGGAACGGTCCTTCGAGCAACAACTGGA<br>CGGCAAGGCCCAGAAATGGAAACAGGCGGAGGACGGAGATTGGTATATCGCCGTGATAGGCGCGTCAGAAAG<br>GAAAACTATCGAGTCCCCCTCCAGCGGTACGAGGGCAGGCTACACCACCACGCATACGCTGGATCCGAGTAG<br>CTTTTGGGACAGGATGGTGTTGCAAAGGGCAATTAGCGACTCTGTACGATGGTACATGACCAACTATCAGGA<br>CTTTTGGTATCATGAGGATGCGGATGCACTCTTTTATCCTTCTCCTAGAGGCAAAGTGGACGAGTACGACGT<br>CTACACCGGATTTAGTCATAGGGTCGAGTTTTATGACAGCCCACAACTTGTCGTGCGCAGCGTCACTAAGTT<br>CATCTCCAGTGAAAGCCTGGCGGACCGGATCAACCATCAGGGCACAGAAGAAGCAACGGAAAAATACGGTGG<br>TGAGAACTTTAGGCTGGACAGGCCGGAACCAACCAAATGTACTTTGCACGGCATCTCAACCGAGCGAACGGT<br>AAGTGACAAGACGATAGATTTTGGTGACGAGATGCTGTCCGTGTTGGAGTTTGCACAAAGAAAATATGGCAG<br>CGAGTGGGCGGACAAAATCGATCCCGACGAACCATTGGTGCAGATACGCTTCGGGAACAGCGACCCCTACGA<br>CACCGCTCCGAGCCTGCTGAATGCGAGCCCTGAGGAGCTGAATCGCAGGCTGACCAGCGAGGCAGCCCTCAG<br>CGCACAAGAAAGGCAGAAGGCCATACAGAACTTCATCGGCAGGATACACTACATCCAGGTTGAAGACGAGAA<br>GGTGAGCGTCAGCGATGACGGCGTACGGCCCACCGAGCAGGGCGACTTCGACTACCCCGATCTTGCGTTTGG<br>CAATGACGAGGTGCTCAGCACCGGCGTCCCGAACGCGGTAGATCCTAGCCAGGAGGTGCACCCGGGCAACTG<br>GCGATGGATAATCAGGGACTACCTGGAGGAATACGGCTTCTGGGAGTCACAACGAAAGCTGTCTGAGATCGT<br>GCTGGTGTACCCGAGAGGCGAAGAAAGACGGGCAGAGAACCTGTACCAGGACGTTAGGGAGAAGCTTTCAGA<br>GATAGGAGGCGTTCAGATCAGGAGCGATCCACATCGCGTGTGTTACACCGATCAGGTGGAGTTCGACGAATG<br>GGTGGCTGAATTCGGTGACTCAATCGACGGTGTTCTTGGATTGATTGAGGGAGATGGAGACGAATACTACGA<br>AATCATAGATGCATTTGGCGGAGCACCGACCCAGTACGTCAACACTAGCACCTACTCAGAGCACAGAGGGGC<br>GAGCGACGACGTGATCTTTAACACTGCTTGCGGACTGGCCGTGAAGTTGGGCGCATATCCTTTTGGCCTGGC<br>CAACGACCTGAACAGTGACGTGTACCTCGGCCTTAGCGTGGCAGGGGATAGAAGCACAACGGCCACCGCCGT<br>TGCCATAGACGGAAGAGATGGGAGGATTCTCTATCAAACAGAGGAACCCCTGGGCCAGGGTAGCAGCACAGT<br>AAGCGAGGGCTATCCCGCTAAGCGAATCATCCAGAGGAGCCTGAAGACCGCCTCAAGCGCCTTTGATCGACC<br>AATCGAGAGCTTCGACATTCACAGGAACGGAGACTTTGGCGACGCTGAGCTGGAAACCCTTAGCAGTGAATT<br>GCCTGCACTCCAGGACCAGGAATATGTGCATACCGATGTTTCATGGAGCGCCGTCGAGGTAATTGAAAACCA<br>CCCTTACAGGCTCTTTAGTGAACGGGGCAGCAGAGCTCCCGATACCGGAGCCTATGCTAAGCTGGACGACGA<br>GCATGTACTGGTTACTACCTTTGGAGAGCCCCAGATCCACCAAGGTACGCCAAAACCGGTCCTGTGCAAGAG<br>GAGAGCAACGAGCCAAGATCAAGACATCACCGCCATCGGAGAGGACGTGTTCAAACTCAGCTTCCTTAACTG<br>GGGTAGCCCAATGATGAAGATGAAGCCACCTGTTACCACTAAGATTCCGAAGGAACTCAACGAGATTTTCGA<br>GAAGTGCTCTAGGGTGAGATACCCCCCCCTTCTAGTAACTCGAGGTTAACTTGT |
| 270 | 83 | GGTGTCGTGAGGATCCATGCCTAAGAAAAAAGGAAGGTTGAAGACCCGAAGAAGAAACGCAAGGTCGGCAG<br>CGGAAGTATGAAGACGCAGGATGATATCGCGCACAACAACCCATTACCATCGAGGTCCAGATCCTGAAGGA<br>GCTCGACAAGCCAAGCCCAAAAATGGCCACCCGGTTCCTCGTGGCCGATAGGGACGGCAACAGGTTTAGCCT<br>GGCTATCTGGAAGAACAACGCACTCAGCGACTATGACTGGACGATTGGCCAGTGGTACAGGCTGGAAAACGC<br>CAGAGGAAATGTCTTTAACGGCAAACAGTCCCTCAACGGTAGCAGCAAAATGCGCGCCACTCCACTTGAGGC<br>CAGCGAGGAGGACGAAACCAGCACGGATGATGTGGGACGGGTCGACACAATCCTGGGTAATATGAGCCCGGA<br>CCAGGCTTACCTGAGCCTGTTTCCCATCAGTAGGTCTTTTGATACCCTGTCTGTGTACGAGTACAGCATTGA<br>GGCAGCCGAGGCATTCGAGGATGCGCCGGACACCGTGACCTACAGGTGCGCTGGCAGGCTTCGGAGAATCAC<br>GGGTGCGGGGTCGCTTATGCTGGCTCAATGAGGATCGTGTCAACCCGCAAACTCCCGGACAAGCTCGCGGA<br>CCCCTTTAGCTTGAGTGAACCCACGGAGAGGGAACTGAACGCTCAGGCGCCAGGGACAGGCATAGGATAGA<br>GCGGCTTCTGAAGAGCCTCGTGAAGGCCGCCATCGACGATAGCACCTACGACCCATACCAGATCAACCGAAT<br>CAGGGCCAGGACCCCGAGCATTACCGCTGGCGACGGGCTGTTCGAGGCGTGCTATGAATTTGCAGCAAGGGT<br>CGATGTGATGCCCTCCGGCGACGCCTTCGTGGGAATTGAGGTAAGGTACCACACGCGGAGCCAGGTCACTGC<br>AGACGTTTACGAAGACAAAACCGCGGAACTGGTGGGCACCATCGTGGAGCATGACCCAGAGAGGTACAACAT<br>TAGCGGTACGGGCCGAGTAGTGGGTTTCACTGACCACCACTTCACCGACGCCCTCGACGAATTGGGCGGTCT<br>TAGTTTGGCGGACTGGTACGCGCAGAAGGATCGCGTCCCAGAGGGGTATTGGAGGCGCTGCGAGAGAAAAA<br>TCCTAGGTTGGTTGATATTCAGTACCAGGAAGACGAACCAGCCAGAATCCACGTCCCGGATTTGCTCAGGGT<br>AGCACCCCGCAAGGAAGTTGTCAAGGAGTTGGATCCCGCCTTCCACAGAAGGTGGGATCGAGAGGCCAAGAT<br>GTTGCCCGACAAAAGGTTCAGGCACGCCATAGAGTTTGTGGATCATCTCGGGTCCCTGCCGGATATAGACGC<br>CACGGTGGCACCCGAGCCTTTGGGGCCGTCACTGTCTTACATGAGCACAGCAGTCGACAGGGAGAAGAACCT<br>GCGCTTCAAAGATGGAAGGACCGCCACCACCCCGTCAAGCGGCATCCGGAGCGGCGTATACCAACACCGAC<br>GAGCTTCGACATCGCCTATGTGTACCCCACCGAGTCTGAACAGGAGAGCAAGCAATTCATTTCTAACTTCGA<br>GAACAAACTGTCCCAGTGCCAGTGCGAACCAACTGCCGCTAGGCACGTTCCTTATGAACTCGGCGGCGAGCT<br>GAGTTACTTGGCTGTCATCAATGAACTTGAGAGCGTGGATGCGGTGCTCGCTGTGGTGCCTCCCCGAGACGA<br>TGACCGGATAACGGCCGGAGACATAACTGACCCCTATCCCGAATTCAAGAAGGGCCTCGGGAAGCAGAAAAT<br>ACCCAGTCAAATGATCGTGACCGAGAACTTGGGCACAAGATGGGTGATGAACAATACAGCCATGGGCCTGAT<br>CGCAGGGGCAGGAGGCGTTCCGTGAGGGTGGATGAGATGCCGGGTGAGGCCGATTGCTTCATAGGACTGGA<br>TGTGACTCGCGACCCGGAAACCGGCCAACACCTTGGCGCTAGTGCCAATGTCGTTTATGCCGACGGAACCGT<br>TTTCGCCTCTAAAACGCAGACCCTGCAGAGTGGGGAAACGTTCGATGAGCAGAGCATAATCGACGTGATCAA<br>GGATGTATTCCAGGAGTTCGTTAGGCGCGAGGGGCGATCCCCTGAACACATTGTTATCCATAGGGATGGCCG<br>GCTGTTTGAGGACGCCGACGAAATCCAGGCCCCGTTCGCGGATAGCGGAGTGAGCATAGACATTCTGGACAT<br>CAGGAAATCTGGCGCTCCGAGGATTGCCCAATACGAGGACAACAGCTTCAAGATTGACGAGAAAGGCCGACT |

TABLE 19-continued

Argonaute nucleic acid sequences containing 2 nuclear localization sequences and a cloning sequence

| SEQ ID NO | Argonaute | Sequence |
|---|---|---|
| | | TTTCATCAGTCAAGATGACACGCATGGATTCATCGCCACAACGGGAAAGCCGGAATTTGATGATAGCGACAA CCTGGGCACTCCCAAGACTTTGAGGGTAGTGAGGCGGGCTGGTGACACACCGATGCTGACTCTGCTGAAGCA GGTGTACTGGCTTAGCGAGGCACATGTTGGCAGTGTGAGCCGAAGCGTTCGCCTGCCTATCACAACTTACTA TGCAGATCGCTGCGCCGAACATGCGCGGGAGGGGTACCTGCTCCATGGCGAGTTGATCGAGGGTGTGCCATA TCTGTAGTAACTCGAGGTTAACTTGT |
| 271 | 87 | GGTGTCGTGAGGATCCATGCCCAAAAAGAAAAGGAAAGTGGAGGATCCGAAGAAAAAGAGGAAGGTAGGCTC CGGGAGCATGAAGCCAGTGAACTTGGATGAAAACAGCCTCAACGACGTCCCGGTAGGCGACACCTATGCTGT CCGCTTCACTCTTGATGCAGTCTTCGAGAACGAAGGGCAGTATCCCGGAGGAATCTGAAATTCACAGACGG AGGGGGGGATGACCGAACCATCACTATTTGGAAAAACTCTGCACCCGAGGAAATTTACGAGGCGGACTATGA GCGCGGTGCGACGTATCTTATTACCGCCGTCGAGTATGACATCGACGAAGGTAATGACGGCGAGCGATACCA GAATCTCACAGTCCAATCAGATGCTACCTTGCTGGAGATGAGCGGTCCCCCTAGTACCGAAGAGGCCTTGGA AGACGGCCTCGCCGAAACCCCAGATACTAGCGCCGATTCAGGTGACCACGGGTTGACAACCTTTAGGACTAC AGACGACCTGCCGGATTATGACGTCTATGAGTACGAGCTGGTGCCGAAGCAAGGATTCCGGCCGTCCGGAGA AAATGCCCTCCGAGCCACATACAGGGCACGACGCAAGGTCCGCCAGCAGTTGGACGTAACACCCGTCGTGGT CGGCGATGCGTTTAAGCTTGTGTCTCTGGTCAAGCTGGCCCACGAGCGGGTCGAGCTTCCGCGATTCAAGAT CAACGAGGTTGACGAGAGGCCCATCGTCTACGCCGATGAGGATGACAGGGATGTGTTGGGGGAAATGCTCGG TGAGATCCTCAAGGACGCGAAACGGGACCAGTACGACATCCATGGCATCGACAAAATACTGGAGCCAGAGCC CGTCATAGAGAAAGAGGGCTTCAGGCTCCACGAACGGTACAACCTGACCGTGGAAGTTCTCCCTAGCAGGGC CGCTTACCTGCACGTGGACTATCGACATCGGATATTGAGCGACAGGACCCTGGATCAACTCGATGAAGACGA AATCCACCCTGGCCTGCGCGTGACCCCCTCATATAGGGACATGGGTCTGTACGTTATAGGCGTTGGGCCGGA GACGGTGACCGATAAGCTGCATATCGAGGGCAACAAGAGCCTGGTCCAATACCATCGGGAAGAGCCGTGGGT GGACCCGGCGAAGGTGCAAGAAATCAAAGACGGCAGGTAGGGAAGTGATCTGGACCGTGAGGCAACGGGCGA TGGCACCGAGATGGCATTCCCGCCGGAGCTGCTCGCGCTTCAAGGGCACCCCGAAAATTTGGCCCAGTTCGC CAGCGACTTTGCTGAACAACAAAGGCTCAACACGCGCCTTTCCGCTGAGCAATGCATCACCAAGGCTAAAAG GTTTGTGGAGCGACTCGGGCCCTTGCAATTCGACGGACACACTGTGGAATTCGAGACCAACCCGCTGTTGGG CGATCGGAACATAGCCATAGATGGTCTGTTTCACCCGGAAGCAAACGTGCTGCAGTTTAGCGGAGGCCAGAC CGGCACCCACCCCTCAGATGTGACACAGCTGGGCGTGTACGAAGCCCCGGACCCCTTCAGGGTGTGCCACAT CAGGATGGAGAAGCGGGACAAAAGAATACAGAGGGGTTGGAGTACCTTGGAGACGAAGCTGGAGCAGATTGG AGCGCCTCCCGACAGTGTCGAGGAGGTCACGTTCGACGCCACAATGAGCCCTGACCAGTTGGGTATGGAGAT AGCGGCCGAGATACCGGACGACCATGATTACGACGCGGCCTTCTGCACATTGCCACCTAAAGACACCGGCTA CTTTGACACCGCAGACCCCGAGCGAGTTTACGATGAACTTACAGAAAAGTGTTGGCCACCAAAGACCTTAACTC CCAATTCGCGTATGAAGCAACGCTGGACGAGCGCTTTACAATAATCAATATAGCACTGGGTCTTGTCGCCGC AGCGGGAGGTATTCCGTTCACAATCGAGAGGGCGTTGCCAGGCGATAGCGAACTCCACCTGGGAATCGATGT AACCCACCAATACGACGAGTCCGCGAATGGCAACCACATTCACCTCGCTGCTGCGACGACGGCTATCCACGC TGATGGAGCTGTACTGGGCTACACCTCCAGCCGCCCCTCAGTCTGGGGAAAAGATTCCCCCCAAGGAGCTGAA AGAGATCATCAAGCAAGCGGTGATGGGCTTTCGCACACGCTACGATCGCTACCCAAATCATATAACCATCCA CAGGGACGGGTTCGCAAACGAGGACCTGTCCGAGGTAGAAAAGTTTCTGACGGACCTCGACGTTGAATATGA TGTTGTCGAGATCAGGAAGCAGGCCCCAGCGCGCGTCTTGAAATACAGTGGTGCCCACTTCGACACGCCTCA AAAGGCGACCGCCGCAATCTACGAAGACATCCCGAAAGCGATTGTAGCGACGTTTGGTGAACCCGAGACTCT CGCTAGCCGGGAGTCAACCGGGCTTCCCCAACCAATCACGGTGGAAAGGGTGCACGGAGAGACCCCCATCGA GACACTTGCTGCGCAAACCTACCTGCTGAGCCAAGCCCACATAGGCGCCAGTAACGCTACAGCACGCTTGCC CATAACCACCATGTATGCCGACTTGGCTAGTGCAGCGGCAGCCAGGCAACACCTTCCCCCGACCAACAAGCT GAGGGATAAGATCGGATTCATCTAGTAACTCGAGGTTAACTTGT |
| 272 | 86 | GGTGTCGTGAGGATCCATGCCAAAGAAGAAGCGGAAAGTCGAGGACCCTAAAAAGAAACGAAAGGTTGGCAG CGGTAGCATGAAGAACCTGAGATACAAAATCAACGCCTACAGAATCAAAAAAGCTATATTCCCAAGGAAGT TTATAGATACAGGATCCGCTCCTTCATAGAGAACATTAACATATATAGGTTCGTCGGTTTTTACGGAGGCGT GGCCCTCAATCAATCTGAGTTTATCCTTCCGTACCCGGTCGAAAATCTCGTCCTGGAATACGACGGAAAAGA TGTAAAGCTTGAGCATATCGACACACTGAACCTGGAGGACATCGAGAATAAGGACAAGGAGAAAGCCGAGAA GCTGGTGAGGGGATACCTGACCAGCATATACAAGTTGAAACCCATACTCTACAAGATCCTGCGGGACGTTCG AGAGAGCAAGATCATTAACGATATCAGATGGATCCTATACCCGACTTTACAGTAAAAAGGCACAATAACGA ATACTACCTTGTCATCGATTTTAACCACACCGCGACCGTGTTGAAAAATCTTTGGGACTTCGTGGGAAGGGA CAAGCTGAAACTCGAGGATTATATCGGTAAGAAAATCATATTCAAGCCCAACCCGAAGAAGAGGTATACTAT AAAGAGCATTGAAAAGCAGAACAAGAAGGACATTGATGACATTGTCGAGCACATCATCGAGTACTACAAGTG GACGGAGGAGGAAATTAAGAGCCACTTCGGCGAAATCGACTATACTCAGCCCATCATCCATTGCGAGGGCAT CCCCTACCCGTTCGCACCGCAATTTTGCAATATCGTATTTACCATGGAAGACTTGGATGAGAATACCCTCAA GGACCTGCAGAGCTACTGGAGGTTGCCCAACGAGATCAAAGGCAACATTATCAATCAGATCGCTAAAAAACT GCGATTTGTGGAGAACGAGCCAATCGAATTGGAATTCATTAAGTTCAATAACACCCCCCTTATCGTGAAGGA CGAAAATGGCAAACCAACAAAGATATACACCACCAATCGCCTCTTCCGATGGAATTACGATAGTAAATCAA ACTGTACTTGCCCTACGACATCCCTGACATAATCAAGAACAAAACACTGACAACGTTTGTGCTGATCGACGA GAATCTCAAAAACGTGAGTGGTAAGATCAAGAGAAAGGTCTACCAAATGTTCAAGAATTACAATAAGATCGC CAGCAAGACTGAGCTCCCGAAATTTGACTTCGCCAATAAATGGAAATACTTCTTAACAACAACATCAGGGA CGTGATCCGAAAGATTAAGGATGAGTTCAACGAGGAGCTTGGCTTCGCGCTCATTATCGGCAACCGATACTA TGAAAACGATTATTACGAGACCCTGAAGATGCAATTGTTCAACCTGAATATCATCTCCCAAAACATTCTCTG GGAGAATTGGTCAAAAGACGATAATAACTTCATGACAAACAACCTGCTCATACAAATTATGGGCAAACTCGG AATTAAGTACTTCGCACTGGACGCAAAAGTGAACTATGACTACATCATGGGGTTGGACAGCGGCCTGGGCGC ATTCAAAAGCAACAGAGTGTCCGGGTGTACCGTGATCTATGACAGCGAAGGGAAGATCCGACGGATTCAACC AATTGACTGCCCAGCCCTGGGGAAAGGATCCCCATTCACCTGGTAGTGAGTTCCTGGAGACCAAGGACCGA CATCAATATGGAAAACAAAAACATCCTGTTCCTTCGAGACGGCTTTGTGCAGAATAGTGAGGGGAGGAGTT GAAGAAACTGAGCAAAGAGCTGAATAGTAACATCGAAGTGATCTCAATCCGCAAGAATAACAAGTATAAAGT CTTTACCAGCGACTACGGTATCGGCTCCATTTTTGGCAATGATGGCATATTCCTGCCACATAAAACTACATT CGGAAGCAACCCGGTGAAGCTCAGCACCTGGCTGCGCTTTAACTCCGGGAATGAGGAAAATTTGAAGATAAA TGAGTCTATAATGCAACTTTTGTACGACCTTACCAAAATGAACTACAGCGCTCTGTACGGGGAGGGTAGGAA |

TABLE 19-continued

Argonaute nucleic acid sequences containing 2 nuclear localization sequences and a cloning sequence

| SEQ ID NO | Argonaute | Sequence |
|---|---|---|
|  |  | CCTTCGCATCCCGGCACCGATTCACTACGCCGACAAGTTTGTGAAGGCCCTTGGAAAGAACTGGAAAATAGA<br>CGAAGAGTTGCTGAAGCATGGCTTCCTCTACTTCATCTAGTAACTCGAGGTTAACTTGT |
| 273 | 82 | GGTGTCGTGAGGATCCATGCCTAAGAAAAAAGAAAGGTAGAGGACCCGAAGAAGAAGCGCAAGGTCGGCTC<br>CGGAAGCATGAGTCAAGACTCTAGGAGCACCGAGGTGGAGAGGCAGGCCGAAATACAACCTGGTACCTACCT<br>GTTGAACGGCCGGGGGGAAATTCAGTTGGATGAGGTTGACGCATTCCAGTACGACCTCAAGGTGAGTGGAGG<br>CGTGGAGCAGTATTGGGATCGGGAACAATTCACCAGCTCTGCAGCCTACTACCTGGACCAGGAACACGGGAG<br>CCCTGTCGCTGAGATAGGCAAAATGAACGTGCTCAGCAAGACGGATTTGTCTAGATCAGTTAGAGTGTGGCA<br>GAGAAACGTGACTCCCATCAATAGGCAGAGCGTTACACTGACCGCAGCCCAACCCGAGGACCGAGAAAAGAT<br>CAAATCATTCGTGCAAAGCTGCTTCAAGAGGGCAGTGCCGACCGAAAAATACAGCTTTCGCTTTCTCAACAA<br>GATTGTCAGGGATGAGCCCGAGTTCACCACCGGCAGCGAAGGCTTTTCTGCACATCCGAAGCACGACGTTAA<br>GATACAGGTCACCGCTGATGGCAATGTGCTTGTGCACGTGGATAGCGGGTTCAGCATCAGGAGCAACAGCAC<br>CCTGGACGAAATCTACTCTGAACAGGATAACCCTTACGGTAAGCGCGTTGCCCACGACCCCGAGAGGTATGG<br>TACCCAGGGCCAAGGCACCCTTCGCGTTGGAGCGACTATCGGTACACAGACCATATTAGCGATGCGGGTAG<br>CTCTGTGAACGAAATGCACAAAGGGGTGGCGGCGAAGAATGGCGGCAACGACTCGCAGAGGAGAATCCCCG<br>ACTTCTGAAAGTGGAGTATGGCAACAAAACTAGGAGGCAAGCCCCCCATTTCCTGAGGCTCTCACCGCGGAT<br>CGAGCAGGTGCAGGATCAGGATCGCGAGTTCTATAGCAGGTTTAACAGCCGGAGCGCGATGATGCCCGACGA<br>AAGATTTGAACTGTCTAAAGAGTTCCTGCAGAACGTGAGCCGCTTGCCGGTATTGGACATGGAACTCGAGCC<br>GGGTCCGGTGAACAGCAGTTACGAGTTGCTGGAAATGCGAGGGAAAACAGGCTGGTTTTTGGAGGGAAGCA<br>GAGGGCTAGAGACCCGGGCAGCGGGCTTAGAGAGAATGGGGTGTATCAAAGTCCCAGTCAGTACCGGCTGGG<br>GGTGTTGACCCCCGAACGATGGGGAGAGAAGGCGAGCGAGCTGATCCCCCTGATTGTGTCCGGCCTGAACGA<br>TCTGAGCGCATCAGCAGGAGTTCGAGCATATGGATACGAATTGGGGGACGTCAGCAATTACACACCCGTGGT<br>TCAGGACCTCCACGAGGAGACGGACGCTGTGCTCGCCGTGGTCCCCAATAAGGGTGTGGCCGAGGATTTTGG<br>GATAGACGATCCATACAAGGAGCTGAAAAGAACCCTCCTGCCGAAAGGGATACCCACCCAAATGATGCAAAA<br>GTCCACGGTCGATGAAATCGTGGGTCAAAAGGCGGGAATCGGCAATGACAAGTTTCTGAACGCACTTAGTGC<br>AGTCGTGGCCAAAGTGGGCGGTACCCCATGGCAGATCGATAGCCTCCCCGGGAAAACCGACGCCTTCATGGG<br>CTTGGACGTAACTTACGACGAGAGTAGCGAGCAGCACGCAGGCGCCAGTGCAAGCGTAGTACTCGCGGATGG<br>GACGACTTTCGCAGCCGAGAGCACCACCCAGCAAGGTGGCGAGAAGTTCAGTGCACGGCATGTAGAACAGTT<br>CGTGAGGGACCTCGTCTTCGACTTTGCGGGGGAACAGGGCCGAGACATCGACAGACTGTGCATAATGAGAGA<br>TGGGAAGATCAGCGAGGATATTGACGCCTAAGAGAGGGACTCAGTGGTATTGAGGCGGAGATCGACATAGT<br>TGGCATACGAAAATCCGGGCAACCTCGCATAGCTGAGTTTGACGGTACTCGGTTTCGGATCGCCGAAAAGGG<br>CGTGGGCTTTGTGGACGCCGACAGAAGCCAGTCTATCATCCATGCATTCGGCAAACCCGAAATCCACGACGA<br>CAATCCTGTGGGCACCCCACGAACCTTTCGACTGACCAAGGACTCTGGTCCCACAGATGTGGAGACCCTGAC<br>CCGACAGGCATACTGGTTGTCCGAGATCCATTTTGGAAGCCCCGTTAGGTCCCCTAGGCTCCCCGTGCCAAT<br>AGAGTACGCAGACATGGCTGCTGAGTATGTTCGGGAGGAGTACGTCTCACCAGGGACTGTAATAGAAGGGCC<br>AGCATACATCTAGTAACTCGAGGTTAACTTGT |
| 274 | 8 | GGTGTCGTGAGGATCCATGCCCAAGAAGAAAAGGAAGGTAGAGGATCCAAAGAAAAAGCGGAAGGTTGGAAG<br>TGGAAGCCTCCCCATCGTCCTGAACGCCTTCCCACTTAAAGTACCCGAACTGGAGCTGGAAGTTAGGCAAAT<br>ACCGTACGATAAAGAGACGTTGACGGCCTCAGGGCTGCGCACAAGGCCACCCACGCTTTCGCAGGCAGGG<br>CGACAACATACTGATTTTTTCCGGTGATGGCACATTTCCCGCGTCTGGGACGCCTCAAACTATTGCACTGAA<br>GGACAATTTCGGCGTGTTCTACAGCCTCGTGAAGGATGGTCTTATCCGCCACCTTGCGGGGCTCGGGAGGAA<br>TCCCAGCGGGTTCAACCCCATAGAGTTGGTGTCCGCAAAACCCGAAGACAACCTGCTGGTCCCCATACTCGG<br>CGATGCGTATCCTTTTAAGGTGTGCGCGAAATACAGCATTGACACCGAAACCGTGCTGGGGCACCCATGTCT<br>GGTGATCGATTGCACGACCAGGAGGGTGTTGAAGGAAAATGGCTTGTTCTTTTTGAACGCTGGGTTCGACCT<br>CGCCGGGCAGGTACGTGGTGACGGAGCAAGATGACGGGTACAGGAAATTGCTCGGCAGCGTGAGCGGCTGTAA<br>GGGTGAAACGCTGTACGTGACTAGGCCCGATGGCCAAGTGGTGCAGGCCGAGGCTAAAAACGTGTACCTGGA<br>GGCATCCCGCACAAATTTCGACGACTATATTCTGCACAACCCACAGGGCTCAGAAGGACGCGATCGTTGAACG<br>AATCAGACAGTCCGTTTCCGTGTTTAATGGGGGCGAAAATAAGAAAGCCCGAATCGACACGCTGAAGAAGTA<br>TATCCAGTCCAAAACCATTCCCTTGATCGACGGCACCAGGATTGAGATCAAGATTCCCTAACATACAGAA<br>AGACTGCGGCCAGATGCAAAAACCGGTATTCGTCTTTAACGACAACGGCGAGGCGGACTGGGCGGAGAAGGG<br>GCTGACCCAATCTGGGCCGTACACCAAGAGGACCTTCGACAGGAATGACCCCTCCATTTGCGTGATCTGCGC<br>CCAACATGACAAGGGACGCGTTGAGCAGTTCGTCAGGAAGTTGCTTAAGGGCATTCCAAACTCCAAATACTT<br>CAGCAACGGTCTCGAGGGGAAGTTTACCCTGGGCACTAGCAGGGTAGAAGTGTTCGCGACCGCTACTGACAG<br>CGTAGACGCCTACAAGAACGCTATTGAAGCCGCAATACGGAAGAAGGCCGACGACGGCGGCAGGTGGGACCT<br>GGCCCTGGTTCAAGTGAGGCAGAGCTTTAAGAAGTTGAAAGTGACCGAGAACCCCTACTACCTTGGCAAAAG<br>TCTGTTCTTCCTCCACCAGGTGCCCGTCCAGGACTTTACCATTGAGCTGTTGGCTCAGTCCGACTACTCCCT<br>CGGCTACTCTCTGAATAACATGGCCCTTGCATGCTACGCGAAGATGGGCGGTGTGCCCTGGCTGCTTAAATC<br>TTCACCCACCCTCAGCCATGAGCTTGTGATAGGCATCGGCTCCGCCAACATCGGCCAGGAGAGAGGAGCTGA<br>TAATCAGAGAATTATGGGCATCACCACTGTGTTCAGCGGAGACGGCAGCTATATCGTGAGCAATACATCTAA<br>GGCTGTTGTCCCCGAAGCTTACTGCGAGGCCCTTACCGCCGATGCTGGTTTATCTGATAGGGCAGAGGAGCTGCGGCA<br>GAGGATGAACTGGCAGAAGGGCGATACCATCAGATTGATCTTCCACGCTCAGGTCAAGAAATTCAACAAGGA<br>GGAAATCGAAGCGGTCAGAGCCGTCATTGAGAAATATCGGGAATACCAGATCGAGTACACTTTTCTGAAGAT<br>AAGCGAAAACCACGGGCTTCACATGTTCGATAGTGCAACCGCAGGGGTGCAAAAGGGCCGACTTGCCCCTCC<br>GAGGGGGAAGACGTTCAAGCTGAGCAAACATGAGATGCTGGTTTATCTGATAGGGCAGAGGGAGCTGCGGCA<br>AGACACCGATGGTCATCCCAGGGGCGTCATCCTTGATGTTCACAAGGACAGTACATTCAAAGACATCACCTA<br>CCTTTCAGCCCAGCTCTACTCATTTGCCAGCCACAGCTGGCGCTCTTACTTTCCCAACCCTATGCCAGTAAC<br>CATTTCATACAGCGATCTGATCGCTCGAAACCTTGGTTGGCTGAACCAACTGCCCGGGTGGAACGACTCCGT<br>GATGATCGGAAAGATCGGGCAAAGCCAGTGGTTCCTGTAGTAACTCGAGGTTAACTTGT |
| 275 | 39 | GGTGTCGTGAGGATCCATGCCCAAAAAAAAGAGGAAGGTGGAGGACCCGAAGAAGAAGCGCAAAGTGGGTAG<br>CGGGTCCATGAAAGAGTTTAACGTCATTACCGAGTTCAAGAACGGCATAAACAGCAAATCTATTGAGATCTA<br>CATCTACAAAATGATGGTCCGAGATTTCGAGAAGCGACACAATGAAAATTACGACGTGGTGAAGGAGCTGAT<br>TAACCTTAACAACAACTCCACCATAGTGTTCTACGAGCAGTACATCGCCTCCTTTAAGGAGATTGAGAAATG |

TABLE 19-continued

Argonaute nucleic acid sequences containing 2 nuclear localization sequences and a cloning sequence

| SEQ ID NO | Argonaute | Sequence |
|---|---|---|
| | | GGGGAACGAGCAATACATAAATGTGGAGAAGAGGGCTATCAACCTGGAGTCCAACGAGAAGAAAATTCTGGA<br>GAGGCTCCTGCTGAAGGAAATCAAAAATAACATAGACAATAACAAGTACAAGGTCGTCAAGGACAGCATATA<br>CATCAATAAGCCAGTGTACAACGAGAAGGGCATCAAAATTGACAGGTATTTCAATCTGGACATAAACGTTGA<br>GTCAAACGGAGACATTATCATCGGGTTTGACATCTCCCATAACTTCGAGTATATCAACACTCTGGAGTATGA<br>AATAAAGAACAATAATATCAAGATTGGGGACCGGGTAAAGGACTACTTCTACAACCTGACCTATGAGTACGT<br>GGGCATCGCCCCCTTTACTATCTCCGAGGAAAACGAGTACATGGGCTGCTCAATCGTCGACTATTATGAGAA<br>CAAGAACCAGAGCTATATTGTGAATAAACTGCCTAAAGACATGAAGGCCATCCTGGTAAAGAATAATAAGAA<br>CTCTATATTTCCCTACATCCCGAGCAGGCTTAAAAAGGTGTGCAGATTCGAAAACCTTCCCCAGAACGTGCT<br>GAGGGACTTTAACACGAGGGTGAAGCAGAAGACAAACGAAAAAATGCAGTTCATGGTTGACGAAGTGATCAA<br>CATCGTGAAGAATTCCGAGCATATCGACGTCAAAAAGAAAAACATGATGTGCGATAACATTGGGTACAAGAT<br>CGAGGACCTGCAACAGCCCGACCTGCTCTTCGGTAACGCCAGGGCCCAGAGGTACCCCCTCTATGGTCTCAA<br>AAACTTCGGGGTGTACGAAAACAAGCGGATAGAGATCAAATACTTCATAGACCCCATCCTCGCCAAGTCAAA<br>GATGAACTTGGAGAAAATCTCCAAATTTTGTGACGAGCTGGAACAGTTTAGCAGCAAGCTGGGCGTGGGGCT<br>CAACCGGGTTAAGCTGAACAACATAGTTAATTTCAAAGAAATCCGCATGGACAATGAGGACATTTTCAGCTA<br>CGAGATAAGAAAGATAGTGAGCAACTATAATGAAACTACCATCGTAATCCTGAGCGAGGAGAACCTGAATAA<br>GTACTACAACATCATTAAGAAAACATTCAGCGGCGGAAACGAGGTGCCCACCCAGTGCATCGGTTTCAATAC<br>GCTGAGCTACACGGAAAAAAACAAAGATTCTATCTTCCTGAACATTCTGCTGGGGGTTTACGCCAAGAGTGG<br>CATCCAGCCCTGGATCCTGAATGAGAAGTTGAACAGTGACTGCTTTATCGGCCTGGACGTGTCTAGGGAGAA<br>TAAGGTCAATAAAGCGGGAGTCATCCAGGTGGTCGGGAAAGACGGCAGGGTGCTCAAAACTAAGGTGATCAG<br>CAGCAGCCAAAGCGGAGAGAAGATCAAGTTGGAGACCCTCAGGGAGATCGTGTTTGAGGCAATCAACAGTTA<br>CGAGAATACGTACCGGTGCAAACCCAAACACATTACTTTCCACCGCGATGGAATCAACCGCGAGGAACTGGA<br>GAACTTGAAGAACACCATGACCAACCTCGGTGTTGAGTTCGACTACATCGAAATTACCAAAGGCATTAACAG<br>GAGGATCGCCACTATCAGCGAAGGTGAGGAATGGAAGACGATTATGGGGAGGTGCTACTATAAGGACAACAG<br>CGCGTACGTGTGTACCACCAAGCCTTACGAGGGAATCGGCATGGCCAAGCCCATCCGAATCAGGAGGGTGTT<br>CGGCACGCTCGACATAGAAAAGATTGTCGAAGACGCCTACAAACTGACCTTTATGCACGTTGGCGCAATTAA<br>CAAAATCAGGCTTCCCATTACTACGTACTACGCAGACCTGAGCTCCACTTACGGCAATCGGGATCTTATCCC<br>CACAAACATCGACACTAACTGTCTGTACTTTATATAGTAACTCGAGGTTAACTTGT |
| 276 | 89 | GGTGTCGTGAGGATCCATGCCCAAAAAGAAACGAAAGGTCGAAGACCCTAAGAAAAAGCGCAAGGTAGGTTC<br>AGGCTCTATGTCTGTGGACGCTATGATCAGGAGTATCGGGGTCGCACGGGACCGCCCGCTTCTCGTTTTCCT<br>CGGGGCAGGTGCCTCAATGAGCAGTGGTATGCCGTCCGCCACTCAATGTATCTGGGAGTGGAAACGAGAAAT<br>CTTCTTGACAAACAACCCCGACGTTGAGAAGACCCAGTTCTCCGAGCTGAGCCTTCCCAGCGTCAGATTGCG<br>CATCCAAGCATGGCTGGATCGGCAACGACGCTATCCCGCTCTTGATCATCCCGACGAGTATTCTACCTACAT<br>AGGTGAGTGCTTTGCACGCTCTGACGACCGCAGAATCTACTTCGAGAAGTGGGTCAAACGCTGTAGTCCGCA<br>CCCTTGGATACCAACTGCTTGCCGAATTGGCACGGCAGGGCTTGTGGCCAGCGTTTGGACTACTAATTTCGA<br>TGCCTTGGCGGCTCGCGCAGCTACGTCCATCAATCTCACTGCAATCGAGATTGGAATTGATTCACAGCAAAG<br>ACTGTACCGGGCGCCGGGCGAGGCGGAACTGGCGTGTGTGAGTCTGCATGGAGATTATCGGTATGATCCTTT<br>GAAAAACACCGCTCCAGAACTCATAAAACAAGAGAAGGAGCTCAGAGAGTCACTTGTCCAAGCGATGAGAAC<br>TCACACAGTCCTGGTTTGCGGCTATAGTGGTCGGGATGAGAGTGTCATGGCAGCGTTTTCCGATGCCTATGA<br>CGCAGCTCATTTTAAGGGTCATCACCCCCTCTTCTGGACACAGTACGGCGATTATCCCGCCAGTGAGCCCGT<br>AGCTGGACTTCTTGCTTCACCGCTGGATCAGGAACCTGCGAAGTTCCACGTGCCTGGGGCATCATTCGATGA<br>TCTTTATGCGCAGGATAGCACTCCACGTGAGTGACGGTGAAGCGCGCGAGCGGGTGCGGAAGATTCTTGAGAA<br>CTTCAAGACGGCACCCAGTTAACCAGAAGCTCCCCTTTGCCTTGCCTAGTCTTCCTGTGACGGGTCTCGTCAA<br>GTCAAACGCCATTCCGTTGATACCGCCTGGAGAGCTTATAGAATTTGATCTTGTCCGGTGGCCGCCGTCCGG<br>TGAAGTTTGGAGCACGCTCCGGGAAATAGGGGATAGACACGGATTCGTAGCTGCCCCTTTTCGCGGGAAGGT<br>GTATGCTCTGGCTACGATAGAGCAACTGACACAAGCCTTCGCGGACAATGTAAAGGATGGCGCGTTCAACAG<br>GGTGCCGCTGAATAATGATGACCTCCGCTACGAGGACGGAACCGCCAATCAGCTGATGCGACGCGCTACTGT<br>TCTGGCTTTGGCTGGGAAAGCTGGATGCGCGAACAGTGGGGATGCCATTGTGTGGGGACACGTCTCGCTCAAA<br>AACCGAAAGATTGGATAGGCAACTTTGGACTGTATACGATGCAGTACTTCTGCAGATTCGGCCGCTGGGAAC<br>TAAGCTCGCGCTCGTACTTAAGCCTACGCTGCGGGTTACGGATTCAACTGGCGAGGTAGCCCCGAAAGAAAT<br>TGAACGGGCAGTCAAGGTGCGCGTATTGGGATACCAGCATAACAAAGAGTTCAACCAGGCGACCGACTTTTG<br>GAGGAAAAGGCTCCTGCCCTCAAGAGATCTCCTTGTCAGATTTCCTGATCTGGATGGTGGAAGTGACTTTCAC<br>GATTTCAGGTCGGCCAATATTCGCCCGGCTCACCGACGAAAGGACTGAAACTGTCACACTGAACGATGCCCA<br>AGAGCGATCAGCATCTCAAGTGGGGTTGCAGCTTGCAGAGCCTAAACTGGTGTTTGCACGCACTGTAGGTAC<br>GGGTCCCGCAACGGACACCCTCCCGGTTAGAGGATTGCTGCAAAATAGACCTTTCGATGCTAATCTGACAGA<br>CTTGGGCATCGCGACGAACCTGAGGATCGCGGTTATTGCGCCCGCTCGGGACGCCAGAAGGGTACATGACTA<br>TCTTGGGCAGCTGCATCAGCCTATAGATCCTACAAAGTGGGATGCGGACTATCTGATGAGGTTTCCCGGCTT<br>CAGCTCCGCTTTTAAATGCCCTTTGGACATTCCGCAGCCGGGCCAGGCAGCTTTTGTAACACTTGACGAGCC<br>ACACGATGAGAGTCCTCAATCAGCGCGGACCCTTGCAGGCCGAATCACAGCGGCACTGTCTGCATTGAGGGC<br>GACGGAGAATCCCTCTGTTACAATAATATATATTCCGGCGCGCTGGCACGCGCTGCGAGCATTCGATCTCGA<br>ATCAGACCAATTCAATCTTCATGACTTTGTTAAGGCCCGCAATTCCAGCGGGCTGTTCCACACAGTTTCT<br>GGAGGAGTCAACTCTTGCAAATGGCCAACAGTGCAGAGTGCGATGGTGGCTTAGCCTCGCTGTTTACGTAAA<br>GGCAATGCGCACCCGTGGGCTTTGACGGGACTCGATAGGGACTCTGCCTTTGTAGGGCTGGGCTTCTCTGT<br>AAGACGAAAGATCGATGGCGAAGGTCACGTCGCGTTGGGTTGTTCTCATCTTTATAGCCCAAATGGTCATGG<br>TTTGCAGTTCCGCTTGAGTAAGATTGATAATCCGATAATGCTGCGAAAAAATCCTTTTATGTCCTTTGACGA<br>CGCTAGAAAGTTGGGCGAAGGCATCAGGGAATTGTTTTTGACGCCCACCTCCGGCTGCCGAATCGCGTAGT<br>TGTTCATAAACAGACCCCGTTTCTTAAAGAGGAGCGGGAAGGGCTCCAAGCAGGTCTCGAGGGAGTCGCGTG<br>TGTGGAACTCTTGCAAATTTTTGTAGACGATACGTTGCGATATGTGGCTAGTCGACCAATGCCGAATGGAGA<br>TTTCGAAATCCATGGCTATCCTATCCGAAGGGGCACCACAGTAGTGGTCGACGACCAGACCGACTGTTGTG<br>GGTACACGGCACATCAACCGCGCTCAACCCGCGGCAGAGCTATTTCAGGGCAAACGCCGCATACCGGCCCC<br>CCTTGTGATGAGGCGGCACGCGGGACGTCTGATCTGATGATGTTGGCGGACGAAATATTGGGACTGTCCAA<br>AATGAATTTTAACAGTTTTGACCTGTATGGCCAACTCCCGGCAACCATCGAAACGAGCCAAAGAGTCGCGAG<br>GATAGGCGCTCTGCTGGACCGCTATACGGAACGGTCATACGATTATCGACTCTTTATGTAGTAACTCGAGGT<br>TAACTTGT |

TABLE 19-continued

Argonaute nucleic acid sequences containing 2 nuclear localization sequences and a cloning sequence

| SEQ ID NO | Argonaute | Sequence |
|---|---|---|
| 277 | 29 | GGTGTCGTGAGGATCCATGCCTAAGAAGAAGAGGAAGGTGGAGGACCCAAAAAAGAAACGAAAGGTGGGGTC<br>TGGCTCTATGCCACACACCTCCCTGCTGTTGAACTTTCTGCCCGTCTCTCTTAGCGGCGACACACGCATCCA<br>TGTCGGCTACCGGCCATATAACGAGGATGTGCTGCGGGAACTGAGGGAGGAGTTCGGCGAAAGCCACGTGTT<br>TAAAAGGGACTACCAGGAGGACACGATAAGCGAGATACCGGTCATCCCCGGAGCCGAGCCCCTTAGCGACAA<br>ATCTACTGGCGTGGATCTTGCCGAAGCGCGATGGCTGTGGAAACCACTTCTGAACGCTGCATTGCTTCGCCT<br>CTTCAGCGGAAGCAGAGAGATCACCTCTGATTATCCAGTCAGCGTGCTTGGTAACCCCAAGAACAACTTCAT<br>CAGCCATGCCAATCTCCCCGACTGGGTGAGAATCCTGCCCCTTCTGGAATTCGAGAGCCGAACCCTGTTCGG<br>TGGTAAATCCGGTCCGCAGTTTGGGCTTGTTTGCAACGCCCGAACTAGGCACCAGGTCCTGGCAGGCTGCGA<br>CCATCTCATTGAAAGAGGTATAAGTCCCATTGGCCGCTATGTTCAGATCGACCAGCCACAAAGAGACTCCAG<br>ACTTGCGCCACGCGGTCTGACTGTTGGTAAGGTGAGCTCTATCGATGGGGACACGTTGATCCTGGAGGATCA<br>CCGAAAGGGCTACGAGCGCGTGAAGGCAAGCGACGCTCGCCTTACCGGCAATCGGGCGGACTTCGACTGGTG<br>CGTGAACGCGCTGTTGCCTGGACAAGGTCAAGCAACGCTGAGCAGGGCGTGGGACGCCATGAGCGCCCTGAA<br>TCAGGGACCCGGCCGCTTGCAAATGATCAATCAGACAGCTGAATATCTGAGGACCGTGAACCTTGAGGCGGT<br>TCCTGGGGTAGCATTTGAGATCGGCGAGTGGCTGAGTTCTACCGATGCTCAGTTTCCTGTGACCGAGACCAT<br>CGACCGCCCTACCCTCGTGTTTCATCCCTCCGGCCGACCCAACGACACTTGGAACGAGAGGGGGATAAAGGA<br>CAATGGCCCGCACGACCAGAGGACATTCACCCCCAAACAGTTGAACATCGCCGTGATTTGCCAGGGCAGATT<br>TGAGGGACAGGTAGACAGATTCGTGGGCAAGCTGCTCGATGGCATCCCCGGACTTTCAGTTGAGGAACGGCAG<br>GAAGCCCTACGACGACGGTTTCCTTAGCCGGTTTAGGCTGGAGAGGGCCAACGTGCAAACCTTTCAGGCTAA<br>CAGTGCCGTCCCGCGAGGCTTACGAAGCAGCGTGTGAGGACGCTCTGAAACATGCCGCTGATAACGGCTTTGG<br>CTGGGATCTGGCTATCGTTCAAATCGAGGAGGATTTCAAGGCGCTGCCTGGGCCCCAAAATCCCTACTACGC<br>CACCAAGGCAATGCTCCTCCGGAACAACGTAGCCGTGCAGAACATCAGGATCGAAACAATGAGTGAGCCTGA<br>CAAAAGCTTGGTCTACACTATGAACCAGGTTTCTCTTGCTTGCTACGCAAAGCTGGGTGGTAGACCTTGGCT<br>CCTCGGTGCCCAACAGAGTGTCGCGCATGAGTTGGTGATTGGACTGGGCAGTCACACCGAGCAACAAAGCAG<br>GTTTGATCAGTCCGTGCGATACGTAGGCATCACCACCGTATTTTCCAGCGATGGAGGCTACCATCTGAGCGA<br>GCGAACCGGAGTAGTGCCCTTTGAAGATTACGCCAAGGAGCTGACAGACACCCTCACTAGGACCATAGAGAG<br>GGTGCGAAGGGAAGACAATTGGAAGAACACTGATAGAGTTCGCCTGGTGTTCCATGCTTTTAAGCAGATTAA<br>GGACATCGAGGCCGAGGCCATCAAACAGGCAGTGGAATCTCTTGATCTGGAGAACGTTGTGTTCGCATTCGT<br>CCATGTGGCCGAGCACCACCCTTATTTGATCTTCGACCAAAACCAAGAGGGATTGCCCCACTGGGAAAAGAA<br>CAGGAGCAAGCGCAAAGGCGTCTTGGGACCCAGCAGAGGCGTGCATATAAAGTTGGCGGACAGCGAATCCCT<br>TGTGGTATTTGCTGGTGCTAGCGAGTTGAAGCAGGCGGCACACGGTATGCCTCGGGCCTGTCTGCTGAAGCT<br>GCACAGAAACAGCACCTTCAGGGATATGACCTATCTGGCAGACAAGCCTTCGATTTCACCGCCCACAGCTG<br>GAGGGTGATGACCCCTGAACCATTTCCGATCACAATAAAGTACAGCGACTTGATAGCAGAGCGATTGGCGGG<br>TCTCAAACAAATAGAGACCTGGGACGACGATGCCGTGAGGTTTAGAAATATTGGCAAAGCCCCCTGGTTTCT<br>GTAGTAACTCGAGGTTAACTTGT |
| 278 | 52 | GGTGTCGTGAGGATCCATGCCGAAGAAAAAGAGGAAGGTTGAAGACCCCAAAAAGAAACGCAAAGTGGGCAG<br>CGGAAGCATGTCCGGCCTTTTCCTGAACTTTTACCAGGTAGACATCCCCACCAAATCCGTACCGATCCACAG<br>CGTAGAGTATAGCCATTACAGTTCAAAGGAGGCCTTTATCGCGTTGAAAGAAAACTTCCCCTACTTTAGCTT<br>CTACCGGGATGACGACCGAATACTGATCTGGAAGAAAGACCAAGGATGCCGAGCTCCCCGAAGAAGAACTCATT<br>GATTGAAATTGATTTCACCGAGAAAGCGAAGGTCCTCAGCAAAATACTCGAGAGGGCCATCATTGACTTCAT<br>CGAGCCAAAGGGCTACAAGATATTCAAGAACAAGTACAGCAACAGCTGGGAAATAGTGAGCATGAAGGACAT<br>CCTGAATGGTGGGATCGAGGGACTCAGCATCAATCGAATCGTGCATTTTTCCCCCTGCTTCTTCTTCAAGGA<br>GAACAAACTCATGCTGGGTTTCAGCCTTAGCACAAGCCTCAAAAACGTGTTTACCTGGAATAAGGCGGACTT<br>CGAAAGGTACGGCTTTGACATCAAGGGCCTTAAAGGGAGACGAAGAGCGGATTTTTGCCAACAAGCAATCCCT<br>TAAGAGGTTCCTGGAGACCAAGGGCGCAGTTGCAATGTATGACCAAATTATCGCAAAGGAAAACAAGAACGC<br>GAAAATGTTTAGCATCATCGACGGCTTCTATCGGTGGCTGGAGAGGAACAAGACTGAAATCCAGCTTCCATT<br>CGGACTGAAGATAAATTCAGTGTCTAAAAAGTACCTGCCGTTCGAGGATGAGCTGATCAAGAGCGAGATCAT<br>CCCTAAGCCCCAAAGGTATTTCTATAGCAATAGGAAGAACACCCAGAGCCTGCGGTACTATGACGAGATGGT<br>GAAGACTTATCAGCCCTACTCTCTGGAGCTCTACCAAAACAAACAGATCAACATCGGAATCATCTGCCCCAG<br>CGAGTACCAGGGAGAGACGGAGGGGTTCATAAAGAAGATCGAACTGAAGCTCAAGGAAGTATTCCATTTCAA<br>CAGCCTGATCTTTCACTTCAAGACCATTACGAACAAGGACCTCGCGTCCTATAAGGAGGTTTTGTACGACGA<br>TGAACTGCTGAAGTGCGACCTGATTTACGTCATCGTGAATGAGGCCCAGGAGAAACTCTCACCTAATAACTC<br>CCCTTACTACGTGTGCAAGGCCAAGTTTATAGGCAATGGCATACCTACGCAAGACATTCAGATTGAGACCAT<br>CCGGCAGAACTTGAATGCGTTCACAATGACGAACATCTCACTTAACAGCTACGCCAAACTGGGAGGCACCGC<br>GTGGACCATCGAGAAGGAAGACAAACTTAAGGACGAGCTGGTCATTGGCATCGGCTCCACCCTGTCAGAAAA<br>CGGCCAGTTCGTGCTCGGTATCGCACAAATCTTCCATAATGACGGGCGCTACATGGCGGGTGACTGCAGCCC<br>CCTTTCTACCTTCTCCAACTACGCGGAGAACCTGGAGGATCACCTGTACAAGACCCTGAAGCCCCTGGTGGA<br>GGGAGATGAGCAAAAGCGGCACCTTCCGGCTGATTTTCCACTTGTTTAAAAGTGCCTCTGAGGAGTACGAGAT<br>ACGCGCGATCAACGGCCTGCAGAAGAGGCTGGCGAACTACAATTTCGAATTTGCACTCGTTCACCTGGCCTA<br>TGGACACATTCCGACTCTACTACAACGACGGCAACGGCCACATTAATCAGGGCACATATATACAACTGTC<br>AAAACACAGCGCCCTGCTCCACTTCGTTAGCAAGTCAGACTTGCCCCTGAAAATCGACCTGGACAAGCGGTC<br>TACTTTCACCAGCCTGTTTTACATCGCCAAGCAGGTGTACTGGTTCAGCCATCTGAGTCATCGCAGCTATAT<br>GCCCAGTAAGAGGACCGTGACCATCATGTATCCGTCAATCATGGCGAAGATGACCGAGGAGCTTAAGAAGGT<br>GGAAGGATGGGACTACGAGCGCCTGAAAGCAGTAAGCGATAAGCTGTGGTTCATCTAGTAACTCGAGGTTAA<br>CTTGT |
| 279 | 60 | GGTGTCGTGAGGATCCATGCCCAAGAAAAAGAGAAAGGTCGAGGACCCGAAGAAGAAGCGAAAGGTAGGAAG<br>CGGTAGCATGAAAAAGCAACTCTTCCCCATCCAGTTCAACTTCGACGACTTCCATATCCAGAGGCTTCCCTA<br>CCAGAAGGAGGTGCTGGACAAGCTTCGGCAACAACACAATGCGACCCATAGCTTTTTCCGCAGAGACGATTT<br>TATCTATATTAGCCCAGGGGTAGAGGCCGCAGCGAACCTGGGAGACGTAGTACGCCTCTCTATTACCAAGCA<br>CCCCGAGGTCGTTGCTTCTCTTGTTAGGCACATATTCTTTAGGACAATCAAGGATAAGGTCCCCGGTCTGCT<br>GCCAAGCTTTCACCCATTCACCTTTCCCGCCAAACAGGACAAATACGATCTGGCCCTGAACATGCTCCCCGA<br>GCGCCTGCAGAATGTTATCACCTACAAGAGGATAACCGAGGTACAGCTTCGATTCAACGAGACCGAAGAGCA |

TABLE 19-continued

Argonaute nucleic acid sequences containing 2 nuclear localization sequences and a cloning sequence

| SEQ ID NO | Argonaute | Sequence |
|---|---|---|
| | | ACCCCAGTTCGTCGCCGTAGTTAACCACAGGTACCAGTGGACTATCGACCGAACTTGCGAGCAATTGGTAAA<br>CGAGGGTCTGGACATCCTTGGCCTGGAGGTGAACTCTAGTACGAGCCCTGATTATTCAGACGGAGTTGTGGC<br>ACCAGAGCTGACACTGTTGGGCAGGGTGATGGCCGTGAACGGGGATCACGCCACAGTAGGGACCAACCAGGG<br>TCCGACAGAGTATGCCCTGTTCGAATTGACCTTGTTCAAGTCCAAGGAGAACATAGTGAACTACCTTGGATC<br>TTTGGTGGGCGAGGGTAAAGCCGAACAAATAGTCAACCATATCAAACAAGATGAAAGCAGAAGGCTGCAACC<br>GGACGTTGTGATGAGGGAGATCGAGGAAATGGGAGTGTGGCTGTCTAGGCTGGCCTACAGAAACTTTGACTC<br>CTTTTGCTTCACCATCGGAACGAACAACGCTGTCAGCGGCCAAGCAGGTATCAGACTGGAGGAGCCAAAGCT<br>GATATTTGACGTCTCAGGTACGAACATACACGCTACCCCCACAACCGGGCTCAACACCTTCGGCCCCTATAG<br>TAGAAGCACGAGTTTCGACGTTAACTCTCCGAAGATTCTGGTTGTGTTTCACCAGCGGAACGCAGGCCACTT<br>CGCAGAGTTTCTCGCACAGCTGAAGGGCGGCATCGCTCAGCACGCATACTTTGCTAACGGGATGGTCAGGAA<br>GTATGGTCTCACGGCAATGAGTACCGGATTGCCGAGATCACTGACTACACCGTGCCCCAATATCTTACCGC<br>CATCAATAAGCTGCTTAGGGCGGAGAACGGAAGCTTTGACATCGCCATCGTGGAGACCTGTGAGGATTTCCG<br>GAGGCTGCCTCCCATGGATAATCCGTATTTTCAGGTTAAGAGTTTGTTGTACAGCCATGGAATCAGCACCCA<br>ATTCATCAGAGCGGAAACCGCTCAGAAACCGATTTATTCAATAGATAGCATCGCGCTCCAAATGTACGCCAA<br>ATTGGGCGGAACACCATGGACGGTGCCAATAGGGCCGAGCGTAGATCACGAATTGGTGATAGGCATCGGTAG<br>CTCCATATTGCGCAGCAACCAGTATGCAGGTGCAACCCAAGCTCGAATAGTGGGGATTTCTACCTTCTTCAG<br>CGCCGACGGGAAGTACATAAGCAATAGAAAGACCCAGGACGTGCCTTACGATCAGTACTTCGATGAGCTCTT<br>GCATAACCTTAAAGTCTCCATCGACGAGATTTCCAATAACTACAGCTGGAGCTCAGGCGACCGCATCAGGAT<br>CATATTCCACATCTTCAAGCCCATAAAACACATCGAGCGTCGTCGCAAGCCTGATGGAACAGTACCA<br>GGAGTTCGATATAAAGTTCGCTTTTGTGACCTTTAGCGAGTTCCACCCGTATGTGCTGTTTAATGAAAATGA<br>AAGGGGGGAATTTGATGCGTATAGGAAGGTTTACAAGGGCACCCATGTACCGTGGCGCGGTTACAATGTTCT<br>GCTGGATCCTCGGTCATGCCTGGTCCAGATGCTGGGACCCCATGAGATGAAGACCAGCCGGCACGGCGCTTC<br>TAGGCCCGTCCTTGTGAGAATCCACCGCAGTTCTACGTTTGTAGACCTCGCGTACGTCGTGCAACAGGCCTT<br>TAAGTTTACTAGGCTCTCATTCCGCACGTTCTACCCTGTGCATAGCCCTGTGACGCTGCTCTACAGTAATAT<br>GTTGGCCCGACAGCTCAAGGACCTGAGGGGCATTCCGGGTTGGAACTACGATGTAGCTAGCAGGCAGTTGAG<br>GCACAAGAAATGGTTCCTGTAGTAACTCGAGGTTAACTTGT |
| 280 | 40 | GGTGTCGTGAGGATCCATGCCTAAGAAAAAAGGAAAGTGGAGGACCCAAAGAAGAAGCGGAAGGTGGGCAG<br>CGGTAGCATGCAAGGCACTATATCCATAAACGAGGTGAGGATCCAGCTTAATACTATTAAGAATCTTTCAGT<br>GTTCAAGTGCAGCCTCAGCGGAATTAGCACCCGCCATAAGAACCAGATCGAGTTCATCCTTCGCAGCGAGCA<br>AAACCGAGTTAGCATCTTTGAGGGTGAAGTGATCTTTGCGCTTCCCGTCGAACAGCAGAACCTCGAAAGAGA<br>TAAGCAGGCTCTGTTCAGCTTCCTGGTCAAACAACAAAAGGGATCTCAATCTGAAACAGCTGAGCCTGGTGCC<br>CCTGAGGGAGGTGCCCGAGCGCGTTATCGAGCGACTGACTTTCGCAATGGTTAGCTATCAGGCCATGAAGCA<br>GGGCATCTTCTCTATCTATGGTCATACATTTTTTCGCCCCACCCTTATGACGGATAGGCTTGCGCACAAGGC<br>GGTGGAAGTCACGACGTGCATCGAGGATGGCTTCCTCAAGTTTTATCTGGACCCGACGTACATTGCACTGAC<br>ATGCATAACGGACACAGCACGCGAAAATAGGGAGAACCTGGAACTGGTCGGGCTCTGCTCTTTCCGCAACAA<br>AAACCTTTGTAGCCTTGTCAGGCCGGACGGCTCATGCAACTGCCTCATACCTGGTAAGTTGGGGTATTACGT<br>CCAGGAGATGGGGATTAAGGACGTTGAGGATGATAGCAAGGACTTTCTGGCCAAACGGTTCAATAGCTGTCC<br>CCGGTTTAGTGAGCACACGCGCTTTATACAAGTGAAGGCGAGTAAAAGAGGCACGAAGTACTCCCTGTTCCC<br>TTCTTACGTAGTTTTTAGCAGGTTGTCCCGAATGGACCTCGCTAAGCCAGATGTGCGGTCCAGTTATCG<br>GAAGGCCACATTGATGGACTCTCACGAAAGGCTTAACTTGACCAACGACTGGATAAGACAAATTTTCATGAT<br>CGGGCAGAAGGGCCTTCAAAATTGGGGTGTTATAAAGGTCAACCAGACCGAGATTCCCGTTGAAATTGTACT<br>CACAATTGCCCACGCCATCGCGCCCAAGCTTCTCAAGGCATCTATAAGGCTATATTCCTCCCGGACCAGCA<br>AATTACGAATGACAGCAATAACCCAACGCCTCAAACGCTGAGCGGGGGTTGGCTCTTCACGAATAGGGGTGC<br>GTTCGACAGGAGGGATCCTAATAGGCCTTTTAAAGTAATCAGCCCCTACATCATCGTGCCCAACAATGAGCA<br>AAGCATCAGCTCTTGCCGCCAGCTGATCAACTACTTCAGCAACGGCAGGTACAAGGCCCGGTGCAAGGGTGA<br>CAGAGACTTTATTGGTATTTCATTGCCCGAAAACAAGGGCAAGTACAACACATCATTTGTCAATGCTTTCGA<br>AGAGGAGGACGGCCTGTATTTCGTTGAAGAGACGATACGGGCTACCAGAAGGCGCTGCAAGACATTGTTAG<br>AGACTGGAATATCACGTCCAAGCGGGACATCAATAAACACGCTATAGTGATCATACCGGGCGAGAACGATAT<br>TGACGACAATCCTTTCTATTATCAACTGAAAAAGGCGTTCGTAGAGGGAAGGGATTCCCAGCACCTTCATCAC<br>GTACGAGACTATGAACAAAATCAACGACCCCGACATCGCGTTCGGGCCAATCATGGACAGCCTGTGGTTGAA<br>CATTTACAGCAAAATGGGGGCAAACCGTGCGCCTCGTCCGGCAACGTGCACTGCTTTATCG<br>TATTGGGTTTGGAATTAACCCCGAGACGCACCGGAAACCACATATTCGCAGGGATCGCCCACATCTTCGACAA<br>CTACGGGAGTTGGATAGACGTAGCGAGTGATTCCGCCAACCTCTCCCAAAACGATCTGAACTCATTCGAGGG<br>CACGGAAAAGTACACACAGGGGAGTGCTAGCTTTAAGATCAGTCAGAGCGTGTCCCAGTCCATTGTGTATAA<br>CGCATTGAAGCTGTACCAACAGAAGCAAACTAAGACCCACGAAAACGCCACAAACATCGTCCTGCACAAACT<br>GGGCCAGATCTACGAGTGTGAGGTCATCGGGTTCCTCGAAGGAATTCGCCAAGTGCTCGGGAGTCTGGGCGA<br>CTGCAAGCTGGGATTGCTGCAAATTGAGCAGGAGCACCACCTGCGCCTCTATGGCGCAGCAGCCCAAACCGG<br>CAAGGAGAACAACACGATCTTTCGCGGTTCAGCACTTCAACTCAACCCGGAGAAGCTGGTTATCGCGTCCAC<br>TGGCCGCTCTTACCGGCAGACGAGCTCCGGGCTGTTTATGAATTATCCGGGCATCGGCACCCCCCAGCCGCT<br>CCTGTTGACTTCTATCGTACCGAATCAGCAGATCCTGCAGAAGTACGCTGTAACGCAAACCAATTCTACTC<br>AAGCGAGGACCTGGCGAAACATGCAATGGCCCTGACGCAACTTCACTGGGGGTCACTGAAGGATAATGTAAG<br>ATTGCCGATTACCACGCTTTACGCGCAAAAGGTCGCCGACTTGATTAGCAAGACCAACATGCGGATCAATCC<br>AGGCTTGGGCTACTTCCGACCCTGGTTTCTTTAGTAACTCGAGGTTAACTTGT |
| 281 | 58 | GGTGTCGTGAGGATCCATGCCCAAAAAGAAACGGAAGGTGGAGGACCCTAAGAAAAAACGAAAGGTCGGAAG<br>TGGCAGCGTTCCAGTGTACCTTAATCGGTTCCTGCTGGACCACCTCACATCACCCTTGTCCTTGCCGGCGTT<br>TCGGGTCGAACTGGACCCTCCCCCTTCCAAAGATGAAGTGCACCCGCTCCTGGCTCTCGTCGGTCGGGAAGC<br>GGGAGGGCTCGTGAGGTTCCAGAACAGGCTGATCGGCTGGGAGGCTCCACGGGCCCTCGAAGGTCAGGTTAG<br>GCGAGGCAAGCAGTCATATAGACTGGTGCCCCTTGGCCGGCAGGCACTCAATCTTAGAAAACCCGAAGAAAG<br>GCAGGCGCTCGAGAATTTGTATAGGATCCGACTGGAAAACATCTTGAAAGCCCTCGCCAAACGACATAGGGC<br>TAGAGTCGAACGCAGGGGCAACGGCCTTTTTCTGTGGAGGCCAGAGAATCCCCGAGAGGAGAAGGAGGGGTG<br>GCACCCTTTACCGGGGAAGCCTGTACCGCATACATCTCTATCCTGACGGCGAAGTGATACTTGAAGTCGACGT<br>GCAGCATCGATTTCAACCCACTCTCCATCTCGAGGAGTGGCTGCAACGAGGCTATCCACTCCCTAGGCGCGT |

TABLE 19-continued

Argonaute nucleic acid sequences containing 2 nuclear localization sequences and a cloning sequence

| SEQ ID NO | Argonaute | Sequence |
|---|---|---|
| | | GACTAACGCCTACGAGGACGAGAAAGAATGGGCACTCCTGGGCATCGAAGAGGGGAAGGATCCCCGCTCTTT<br>TCTCTTGGATGGGGGCGAGTCATTGCTTGACTACCATCGCAAGAAGGGACGATTGGCAGAGGGGCAGGACCC<br>CGGTCGAGTGGTCTGGGTTGCTAGAGGTAAAGAACGCGAGCGGATCCCACATCTGAGCGTCTTGTTGAAGCC<br>AGTCATCACCATGGAGCTGCTGGCGGAAGTCGCTGAGGTCACGCAGGAGGCCTTGCCTGCGCTTCAGCTCGA<br>ACCCGAGGAACGGCTGAAGGACATTAGGCGCTTCGCTGAACCTGTACTGCAAGCGTTCGGCAAACGCGAAAC<br>TGCAAAACCCCTTGAAGGCAGAGCCCAGCGATTGCCGCGACCCAGTTTGTTGGCACGGGGAAAAAAGCGAGT<br>GGGCAAAGTAGCGGACGTACTCGAAAAGGGAGCATTGTCACCGGGCGAGACACGGTTGGCCCTGCTCGCATG<br>GGAGGGAGACGGGAAGGCCAAAGGCGGTCTCGCGTACTTGGAGGAGAGGCTTCAGGGCGTCGGGTCTGCATC<br>CGGCATCAAACTTGAACTTAAACGGCGATTTCTGCCCCGAGGCGATAACCTGAAATGGCACAGGTGTTTGA<br>GGAGCTCTCCCAGGAAGGAGTAGGTGCCGGTCTGCTTCTGACTCCGCGCCTCACAGAAGGGGAAAGACGCGA<br>ACTGAAAAATACTGCGGCGAGCCATGGGCTCGCTCTCCAACTCCTTAACCCGTTTGACCCTGGCGACATCTA<br>CAGGGTGAATAACGCTCTGCTTGGATTTCTCGCGAAGGCCGGGTGGCTGTTCCTGAGACTGGAGGGAACTTA<br>TCCGGCCGACCTGGTGGTGGCCTATGACGCAGGCGGGGAGAGTCTCCGATTCGGCGGAGCCTGCTTCGCCCA<br>CCTGACTGATGGCACGCATCTGGGGTTCAGTCTGCCAGCCGCTCAGGGTGGTGAACGGATGGCCGAGGAGGT<br>CGCGTGGGAGTTGCTGCGACCCCTGCTGTTGAGATACCGGAAGGGCCAGACACCAGGGAGGATCTT<br>TCTGCTCCGCGACGGTAAGATTCAAAAGGAAGAGTTCCGAAAAGTGGAAGAGGAACTGAGAAAGCGCAATAT<br>TCCCTACGCGCTGTTTAGCGTCCGGAAGACGGGGGCTCCCGACTGTTCAGCAAAATGGGCCGCTCGGTGA<br>CGGTCTTTTTTTGCGACTGCCAGAGGAGGAGGGCGGGTTTCTGTTGCTTAGCGCCGAGGGTGGGAAGGGCAC<br>CCCACGGCCGGTTAAGTATGTGTTGGAGGCGGGAGAAGTGGACCTCAACCTGGAGGAAGCTGCCAGGCAATT<br>GTATCACCTGAGTCGCATCTACCCGGGCTCCGGTTACCGATTCCCCAGGCTGCCCGCACCGTTGCATATGGT<br>TGATAGGATGGTGAGGGAGGTTGCACGGCTCGGCGGCAGCCATAACTTGAGACTCAAAGAAGAACAACTGTT<br>TTTCCTGTAGTAACTCGAGGTTAACTTGT |
| 282 | 41 | GGTGTCGTGAGGATCCATGCCGAAGAAAAGCGAAAGGTGGAAGACCCCAAAGAAGAAACGCAAGGTGGGCTC<br>CGGCAGCATGAATAACCTGACACTGGAGGCCTTTCGGGGCATTGGCACCATCAAGCCACTGTTGTTCTATCG<br>GTACAAGCTGATCGGCAAAGGGAAAATAGAGAATACCTATAAGACGATACGCAACGCACAGAATCGGATGTC<br>TTTCAACAATAAGTTTAAGGCCACCTTCAGTAAGGATGAAATCATATACACCCTGGAGAAGTTCGAGATTAT<br>CCCGACGCTGGATGATGTGACGATCATCTTCGACGGGGAAGAAGTGCTTCCTATAAAGGACAACAACAAGAT<br>TTACAGCGAGGTAATAGAATTTTACATTAACAACAATCTCCGGAACGTTAAGTTCAACTATAAGTACCCGAA<br>GTACAGGGCTGCCAATACAAGGGAGATCACGGGCAACGTGATCCTCGACAAAGATATGAACGAAAAGTACAA<br>GAAGAGCAACAAAGGCTTCGAACTCAAACGGAAGTTCATAATCAGCCCCAAGGTCGACGATGAGGGTAAGGT<br>CACATTGTTCCTGGACCTGAACGCGTCATTTGACTACGACAAGAACATCTACCAGATGATAAAGGCCGGAAT<br>AGATGTGGTAGGAGAGGAGGTCATCAACATCTGGAGCAATAAGAAGCAGCGCGGTAAGATCAAGGAAATCAG<br>CGACATTAAGATAAACGAACCCTGCAACTTCGGCCAGAGCCTGATAGATTACTATATAAGCAGCAATCAGGC<br>GTCACGGGTGAATGGATTTACGGAGGAAGAGAAGAACACAAACGTCATCATCGTGGAAAGCGGCAAAAGCCG<br>CCTGTCATACATACCGCACGCGCTCAAGCCTATCATAACGCGAGAGTACATCGCCAAGAACGACGAAGTCTT<br>TAGCAAGGAGATAGAAGGGCTCATCAAAATCAATATGAATTACAGGTACGAGATTCTCAAGAGGTTCGTCTC<br>CGACATCGGCACTATTAAAGAACTGAACAACCTGCGCTTCGAGAAAATCTATATGGACAATATAGAAAGCCT<br>GGGTTACGAGCAGGGTCAACTCAAGGACCCCGTGCTCATCGGCGGCAAGGGTATACTTAAAGACAAAATACA<br>TGTCTTCAAGAGCGGCTTCTACAAATCCCCCAATGACGAAATTAAGTTTGGCGTGATATACCCGAGAGGCTA<br>CATAAAAGATACCCAGAGCGTTATCCGAGCCATCTACGACTTTTGCACCGAGGGCAAGTACCAGGGAAAGGA<br>TAACATATTCATCAATAACAAGCTCATGAACATCAAGTTCTCCAATAAGGAGTGCGTCTTTGAAGAGTACGA<br>GCTCAATGACATAACCGAGTATAAGCGGGCTGCAAATAAGCTCAAAAAGAATGAGAACATAAAGTTCGTGAT<br>CGCAATCATCCCCACTATCAATGAAAGTGACATTGAGAACCCCTACAACCCCTTCAAAAGGGTCTGTGCCGA<br>GATCAACCTCCCCAGCCAAATGATCAGTCTCAAAACTGCAAAGCGGTTCAGCACCAGCAGGGGCCAATCTGA<br>GTTGTATTTCCTGCATAACATCAGCCTCGGCATTTTGGGCAAAATAGGCGGCGTACCCTGGGTAATTAAGGA<br>CATGCCAGGCGAGGTCGATTGTTTTGTGGGCCTGGACGTGGGCACAAAAGAGAAAGGAATCCACTACCCCGC<br>ATGCAGCGTGCTGTTCGACAAGTATGGCAAACTCATTAACTACTACAAGCCGACGATCCCGCAGAGTGGAGA<br>GATCATTAAAACAGACGTGCTGCAGGAGATCTTTGACAAGGTTCTGCTGAGCTACGAGGAGGAGAACGGCCA<br>GTATCCCGCAACATCGTGATACACAGGGACGGCTTCAGCCGGGAGGACCTGGAGTGGTATAAGAACTACTT<br>CCTGAAAAAAAACATCGAATTCAGCATAGTAGAGGTCCGCAAGAACTTTGCCACGCGACTTGTAAACAACTT<br>CAACGATGAAGTGTCCAACCCAAGCAAAGGTTCATTCATTTTGAGGGACAACGAAGCGATTGTCGTCACGAC<br>GGATATTAACGACAACATGGGAGCGCCCAAACCGATCAAAGTTGAGAAAACGTATGGCGATATTGACATGCT<br>CACAATTATCAACCAAATTTACGCACTGACACAGATTCACGTGGGGTCCGCGAAATCCCTTAGACTGCCTAT<br>AACCACGGGCTACGCCGATAAGATCTGCAAGGCTATCGATTACATCCCGAGCGGCCAAGTCGATAACAGGCT<br>GTTCTTTCTGTAGTAACTCGAGGTTAACTTGT |
| 283 | 1 | GGTGTCGTGAGGATCCATGCCTAAAAAGAAAAGGAAGGTAGAGGACCCCAAGAAAAAGCGCAAAGTAGGGAG<br>CGGTAGCATGAACTATACCGCTGCTAACACAGCGAACTTCCCGATATTTCTGAGCGAAATAAGCTTTCTCAC<br>AACCAATAACATTTGCTTGAACTGTTTCAAGCTTAACTACCAGGTAACGAGGAAGATCGGTAACCGATTTTC<br>ATGGCAGTTCAGCAGGAAATTCCCCGACGTTGTAGTGATATTCGAAGACAACTGCTTCTGGGTCCTGGCAAA<br>GGACGAAGTTCTTCCCCTCACCACAACAGTGGAAGGAAGCACTTAGCGATATCCAGGAGGTTCTTAGAGA<br>GGACATCGGGGACCACTACTACAGCATCTATTGGCTTAAAGACTTTCAAATAAAGGCCCTGTGACCGCCCA<br>ACTGGCGGTGAGGATACTCAAGATTTTCGGCAAATTTAGCTACCCAATCGTCTTTCCCAAGGATAGCCAGAT<br>ATCAGAAAATCAAGTGCAGGTCAGGCGCGAAGTTGACTTTTGGGCGAGATCATCAATGACACCAACCCCGC<br>AATCTGTCTGACCGTGGATAGTAGCATTGTGTACAGTGGCGACCTTGAACAGTTTTACGAAAACACCCCCTA<br>CAGGCAAGACGCCGTAAGCTGCTGGTGGGACTGAAGGTGAAGACCATCGAAACCAATGGCACCGCGAAGAT<br>CATACGGATCGCCGGTACCATAGGCGAGCGCAGAGAAGACTTGCTGAAGAAGGCCACAGGCTCAATGTCACG<br>ACGGAAACTGGAGGAAGCCCATCTCGAACAACCGTCGTCGCAGTCGAGCTTCGGAAAGAAACCCCCAGGAGTA<br>CATATACCCGCTTGCGGCCCTTAAACCTAGCGTGACCGACGAAGATGAGAGCCTCTTCCAGGTCAACCACGG<br>AGACTTGTTGAAGGAGACCAAGATCCTGTATGCGGAGAGGCAGGAGCTTCTGAAGCTGTACAAGCAGGAGGC<br>CCAGAAAACCCTGAACAACTTTGGGTTCCAGTTGAGGGAGAGGTCCATCAATTCTCAGGAATATCCTGAGGT<br>GTTTTGGACTCCCAGCATCAGCCTGGAGCAAACCCCAATCTTGTTTGGCAAGGGGAGCGAGGTGAAAAAAG<br>AGAGATTTTGAAGGGCCTGAGCAAAGGCGGAGTGTACAAAAGGCACAGGGAATACGTGGACACAGCTCGCAA |

TABLE 19-continued

Argonaute nucleic acid sequences containing 2 nuclear localization sequences and a cloning sequence

| SEQ ID NO | Argonaute | Sequence |
|---|---|---|
| | | AATTCGCCTGGCCATACTTAAGCCCGCTAACCTCCGCGTGGGCGACTTTCGGGAGCAACTTGAGAAGCGATT<br>GAAGCTTTATAAGTTTGAGACAATTCTGCCACCGGAGAACCAAATTAACTTCAGTGTCGAAGGCGAAGGTTC<br>CGAAAAGAGGGCCCGATTGGAAGAAGCGGTCGACAGACTCATAAGGGGGGAGATCCCCGTAGACATTGCACT<br>GGTGTTCCTCCCGCAGAGCGATAGGAATGCAGACAACACCGAGGAGGGAAGCCTTTACAGTTGGATCAAGAG<br>AAAATTCCTCGATAGGGGCGTGATTACACAGATGATTTATGAGAAAACGCTTAACAATAAGTCACAGTACAA<br>CAACATCCTGAACCAGGTGGTGCCGGGGATTCTTGCGAAGCTGGGAAACCTGCCATACGTTCTTGCAGAGCC<br>GCTTGAGATAGCCGACTACTTCATAGGCCTGGATGTGGGGCGGATGCCAAAGAAGAATCTTCCGGGGAGCCT<br>CAACGTGTGCGCGTCTGTCAGGCTCTATGGCAAGCAAGGCGAGTTCGTGCGCTGCCGCGTCGAGGACAGCTT<br>GACCGAGGGCGAAGAGATTCCCCAGCGGATCCTGGAAAATTGCCTGCCCCAAGCAGAACTTAAAAACCAAAC<br>TGTCCTTATCTACAGAGATGGTAAATTCCAGGGAAAGGAGGTGGATAACCTTTTGGCTAGGGCTCGCGCAAT<br>CAATGCCAAGTTCATACTGGTTGAGTGCTACAAGACCGGTATCCCCCGACTGTATAACTTCGAGCAAAAACA<br>GATCAACGCACCCTCCAAGGGGCTGGCACTCGCGTTGAGCAACCGAGAGGTGATCTTGATTACGAGCAAGT<br>GAGCGAGAAGATAGGCGTTCCTCGGCCACTTAGACTCAAAGTGAATGAGCTGGGTGAACAGGTGAACCTGAA<br>GCAGCTGGTCGATACCACTCTTAAACTCACGCTGCTCCACTATGGGTCTCTGAAAGACCCACGGCTGCCTAT<br>TCCCCTGTACGGTGCCGACATCATAGCCTATCGGCGGCTGCAAGGAATCTACCCATCCCTTCTCGAGGATGA<br>TTGTCAGTTCTGGCTGTAGTAACTCGAGGTTAACTTGT |
| 284 | 65 (Helicase) | GGTGTCGTGAGGATCCATGCCCAAAAAGAAGAGGAAGGTAGAAGATCCAAAGAAAAAGCGGAAGGTCGGGAG<br>CGGGTCCATCACCAGCTACCCTTACGCTAGGAACAAGGCCGACATGATTCGCAAGGTTAATTGGAATCTGAT<br>CGTGTTCGACGAAGCCCACAGGATGAGGAATGTCTATAAGAAGTCCAATAAGATCGCCCGAACCCTGCGCGA<br>GGCCACTGCCGGCTATCCCAAGATCCTGCTCACTGCAACCCCCCTCCAAAACTCCCTCATGGAGCTCTACGG<br>ATTGATATCTTTTATTGACCCCCACATCTTCGGGGATGAGACAACTTTCCGCAGACAGTTTAGTCGCGGCAC<br>CAAGGAAATGAGCGAGATGGACTTTATCGACCTGAAACAACGAATTAAACCCGTGTGTCACCGCACCCTGAG<br>GCGCCAAGTCACAGAGTACGTTAACTACACTCAGCGCATTCCGATCACCCAGGAGTTCATGCCCACCAACGA<br>AGAATGGGAGCTGTACGAGAAGGTCAGCGCCTATTTGCAACGAGAACATCTCTTCGCGCTCCCCGCGTCACA<br>ACGAGCACTTATGACCTTGGTAGTGCGCAAACTGCTCGCCAGCTCTTCATTTGCTATTAGCGATACCCTGCT<br>GAGCCTCATCAAGAGGTTGGAACAACTGCTGGAACAGCTGGACTCCGGCAAGACGGAGATTACCGTAGAACA<br>CAGCGATGTCTACGCGGACGTGGACGAGTTTGATGATACAGTGGAGGAGTGGGAGGAGGACGACCAGCCTTC<br>TTACATAGATAAACTGAGCCCAGACGAGATGAAACGGTTGATTCAGGAGGAAAAGGAAGAACTGGAGCAGTA<br>CTACAGCCTTGCAAAAAGCATTAAAGAGAACTCAAAGGCTGAGGCCCTCCTCATAGCGCTTGAAAAAGGGTT<br>TGAAAAGCTCAGGATGCTGGGGGCTAATGAGAAGGCCGTGATCTTCACAGAATCCCGACGCACACAGATGTA<br>TCTGAGAGAATTCCTGGAGAGAAACGGCTACGCCGGGAAGATAGTGCTGTTCAACGGTGAAAACCAAGACGA<br>ACAAGCGAAGCAGATCTATGAGCAGTGGTTGGAGAAGCACCGACACGACGACAAGATTACGGGCTCTAAGAC<br>GGCGGACATGCGAGCCGCGCTCGTGGAGTACTTTAAGGAGCAGGCTAGTATAATGATAGCGACCGAGAGCGC<br>CAGCGAAGGCATCAATCTGCAATTTTGCAGCTTGGTTGTGAACTATGACTTGCCATGGAATCCGCAAAGGAT<br>AGAGCACGATCGGGAGGTGTCATCGCTATGGTCAAAAGCACGACGTGGTGGTAATAAACTTTCTCAATTG<br>TAAAAACGAAGCGGACAAGAAAGTAGATGAGATATTGTCCGAGAAGTTTCGGCTGTTTGAGGGCGTATTTGG<br>CAGCAGTGATGAAGTCCTGGGGTCCCTCGAAAGCGGCGTGGATTTCGAGAAGAGAATCCAACAAATCTACCA<br>GACCTGCCGAACCGCGGAAGAAATTGAGCAAGCGTTCAAGAACCTGCAAGCTGAGCTCGACGAGCAAATTCA<br>ACTGAACGATGAAGGAGACCCGAATGCATCTTTTGGAAAACTTCGATGACGAGGTGAGGGAAAAGTTGCGAGA<br>CCATTATCACCAAACCTCCCTGCATCTGAATAGGATGGAAAGGTATTTGTGGAACCTCAGCAAGTACGAGGG<br>GGCACGCGAAGCCATCTTTGACGACGAGACGCTGTCCTTCGTGAAGGACTACGAGACCTATCAGATGATCAG<br>CCAGGCGAAGAAACAAAACAGTCCAAACGTGCATCACTTTCGATTCTCCCACCCGCTTGCGCAGAAGTGGAT<br>CGAACAGGCCAAGAGCAGGGAATTGTTGCCAAAGGAGATAACGTTCAGGTACAGCGACTACAAGGGCAAAGT<br>CTCCATCTTGGAAAGACTCATCGGCAAGGAGGGTTGGTTGAGTCTGGACCTGCTTCACGTCCAGAGCCTTGA<br>GAGCGAACAACACCTCATCTTTAGCGCCATCGACACCGAGGGCGGTCAACTGGACCAGGAGATGTGCGAGAA<br>AATGTTCGAGCTGCCCGCTGTGGAGGGCGAGGAAGTAGAGATATCCGACTCCATCCGAAACACATTGAGACG<br>AATCTCAGAGGGCCAGCAAGAGGCAATACTGAATGAGATTATGAGCGGGCTCCGCCTACCTCGACTCAGA<br>ACTCGAGAAACTGGAAAAATGGTCACAGGACCTCAAGAATAAGCTGGAGAAAGACATTGATGAAATGACGGT<br>GGGAGATCGAGCATCTTAAACGGGAAGCTAAATTGACACGCAACCTGGCAGAAAAACTCGAAAAAAACAAACA<br>GATCAAGGAGCTTGAGAAGAAGCGCAACGAAATGCGCCGGAATCTCTATGACCAACAGGACGAAATCGATGA<br>ACAAAAGGACCGCCTCTTCGAGGAGGTAGAGAAAAAACTTGAACAACGGACTGCGACGGAGCACCTCTTCAC<br>TATCAAATGGCGGATCGTGTAGTAACTCGAGGTTAACTTGT |
| 285 | 44 | GGTGTCGTGAGGATCCATGCCCAAGAAAAAGCGAAAGTAGAGGATCCAAAGAAGAAACGGAAGGTCGGCAG<br>CGGAAGTGTGAACCATTACTATTTTTCCGAATGCAAGGCGGACGAGAAAGCCAGCGACATGGCCATCCACCT<br>TTACACCGTGCCCCTGTCCAACCCCCATGAGAAATACAGCTATGCGCACAGCATCGCCTATGAATTGAGAAA<br>ACTCAACTCATACATAACCGTGGCCGCGCACGGTCAGTACATCGCGTCTTTCGAGGAGATATGCCACTGGGG<br>CGACCACAGGTACATACAGCACGAACATAGACAATCAGTGCAGCCTCCCGATGGAGAGGACCATACTGGA<br>AAGACTCCTCAAGAAAGAGCTCGAGAATAGGTGCAAAAGCAGCTATAAGATGGACAACGACCTTTTCCGGTT<br>GGCTAACGAGCAAAGCATGCACGTGGGCGAGATCAGCATACACCCAGCGATCTACATCTCATTCAGCGTGGA<br>GGAAAATGGTGACATATTTGTTGGCTTCGACTACCAGCACCGGTTCGAGTACCGCAAAACACTCCAAGACGT<br>CATCAACAACGATCCCTCCCTGCTTAAGGAAGGCATGGAAGTGGTGGACCCCTTCAATAGAAGGGCCTACTA<br>TTACACTTTTGTGGGCATGGCCGATTATACCGCCGGACAGAAAAGCCCCTTCCTGCAGCAGTCTGTGATCGA<br>CTATTATCTCGAAAAGAATGAGCTGTGGAAGCTCAAGGGTGTGCACGAAAAACCCCCGTGGTGCACGTCAA<br>GAGCCGAGACGGTCACTTGCTCCCGTATCTGCCGCACCTGCTCAAATTGACATGTTCATACGAACAGCTCTT<br>GCCCAGCATGACCAAGGAAGTCAATCGCCTGATTAAGCTGAGCCCCAACGAGAAGATGAGTAAGTTGTATAC<br>GGAGATGTTTCGATTGCTCCGGCAGCAACAGGTGCTGACCTTCAAGAGGAAAACGTGCGAGCCGTCAACCT<br>CGGCTACGATGTGAATGAACTTGACAGCCCGATCATGGAGTTCGGACAAGGCTACAAGACAAACGAGATCTA<br>TCGAGGCCTGAAGCAGAGCGGAGTATACGAGCCCAGCTCAGTGGCCGTGAGCTTTTTTGTTGACCCCGAGCT<br>TTACTACGACCCCCAGAAGCGGAAAGAAGTAGGTTGCTTCGTCAAAAAACTGGAGAGCATGAGCGAGGCCCT<br>GGGAGTAAAACTGAACATAAGCGACCAGCCCCGACAACTTTATGGCCAGCTCCCCAAGGACTTTTTCAAGCA<br>GGACAACCTCTCATATCATTTGAAATCTATCACCGACCAGTTCAGGGGAACGTGGTGGTTGTTATCGGCAC<br>TGAAGAGAACATCGACCGGGCATACGTTACAATCAAAAAGGAATTCGGCGGCAAGGAGGATCTGATGACCCA |

TABLE 19-continued

Argonaute nucleic acid sequences containing 2 nuclear localization sequences and a cloning sequence

| SEQ ID NO | Argonaute | Sequence |
|---|---|---|
| | | GTTTGTCGGCTTCACCTCCTCCCTCGTCACGGAGAACAACATTTTTCACTACTACAACATCCTGCTCGGCAT CTATGCGAAAGCTGGTGTTCAGCCCTGGATACTCGCCAGCCCAATGCACTCAGACTGTTTCATTGGACTCGA CGTAAGCCACGAGCACGGTAAGCACGCATCAGGGATAATACAAGTGATTGGACGGGACGGCAAGATTATCAA ACAAAAGAGCGTTGCGACAGCAGAGGCCGGAGAGACTATTGCCAATAGCACGATGGAAGAAATCGTCAACGA AAGCATTTATTCCTACGAGCAGATCTACGGGCCAAACCGCGCCACATAACATTCCATAGAGACGGGATCTG TCGCGAGGACCTCGATTTTCTGCAAGCGTATTTGCGGAGTTTCCAAATCCCATTCGACTTCGTAGAAATCAT AAAGAAGCCGCGACGCAGAATGGCGATATACTCTAATAAGAAGTGGGTCACGAAACAGGGAATATACTACAG TAAGGGCAACACCGCTTATCTGTGTGCCACGGACCCCAGAGAATCCGTGGGTATGGCGCAACTTGTCAAGAT CGTACAGAAGACTAACGGATTGAGCGTTCACGAGATAGTGAGCGACGTGTATAAGCTGTCCTTCATGCACAT ACACAGTATGCTCAAGACCAGGTTGCCTATCACGATACACTATAGCGACCTCAGCTCAACGTTCCACAACCG GGGCTTGATCCATCCCCGGTCCCAACATGAGAGAGCACTCCCGTTCGTGTAGTAACTCGAGGTTAACTTGT |
| 286 | 67 (Helicase) | GGTGTCGTGAGGATCCATGCCCAAGAAGAAGAGAAAAGTGGAAGATCCCAAAAAGAAGCGAAAGGTGGGTAG TGGGAGCATGAATTTCCAGCTGTGCGACCAACGCAAAGCCATTATCGCCGAACCAGGCCATCTGTTGGTCCT CGGTGGGCCAGGAAGCGGGAAAACTACCGTCGCCCTCTTCAAGGCCAAGCAGAGATTTAGCACTCTGAAACC TAGCCAAGAAATCCTGTTCCTGTCATTCAGTAGAGCTGCCATCAGGCAGGTCCTGCTGCGGTGCAAGGAGAT TCTGAAGCCCGCAGAGAGACGCGCTGTCGCCGTTCAAACCTATCATAGCTTCTGCATGGACATGCTGAGGGC GCACGGTAGACTGCTCCTGGGCCACCCCGTGCGATTCATGTATCCCGGCGACGAGAGGCTTCAAAAGGCCGC ATTCGAGGGGGACTGGGAGGCGGAAAGACAAAGGCAAGCCAAAGAGATGGGCATCTTTTGCTTCGACCTTTT CGCGCAAGGCGCAGCTGAGTTGCTCGAGAGGTGTGCCGCACTTAGGAAGCTTATAGGGGACAGCTTCCCCAT GATAATAGTGGACGAGTTCCAAGACACCGACGACAACCAATGGCGGATCGTGGCGCAACTTGCCAAGGTAGC GGACATCTTCTGCCTTGCCGACCCCGACCAGAGGATCTTTGACTACCGAGACGACATCGACCCCCTTCGGAT CGAGGGTTTGCGGACCACTCTTGCCCCCAGGGAGTTCGATCTTGGCGGTGAGAATCACCGCTCCCCGAACGC AGGGATATTGAACTTCGCCAACGCTGTGCTGCATAACCAGAGCCCCCTGCCCGATACCAGCGACATCATGCA ACTGCGGTACTGGCCTAGAGCGTTCGCGAGCACCGTGCATGCCTGCGTAGTGTTTACCTTCAGCGAACTCAG GAAACTGGGCGTGGAGAACCCCAGCGTGGCAGTGCTGAGCCGATCCAACGGGCTTATCAGCGATGTGAGCGC CATACTGGCTGAGAAGCACGCGTACAACGGGAGGGAACTGCCAATCGTGGAACACGACGTGGTTTGGGACGC GGAGCTGTCTGCGGCAGCAGCCGTCGTCGTTGCGTCCACCCTGGAGTGGCCAACAGCCGCTGCAGAGGTTGC TGTTGCCAGGACACTTGCGCTCATAGCAGCCTATTACAAGCTGAAGAACGCCGAGGAACCCACCAAGAGCGC GGCTGAGGCTGCCCAAAAGTACGAGGCGGCTGCAAGCAAGGTGGCCAGTGAGGAGACCCCAAGGATCAAAGC CGCGAAAGAATTGCTGGCCGCTCACCAAAGTGGCATCCAGATGGTGGGCGACCCGGTGGCCGATTGGAAGTC TGCGAGGAGGGTATTGCAAGAGATAAGCGCCCTGGGTGAGTTGTACAGGGAGGTCCGGCTCGTGAGGTTGTT CCGGGCAACCGACGCCTTGGCTTCCGGCCTGAGCAATAGGTGGTTGGCTACTGGAAGCTACGAGGGCGTGTC CGACCTGGTGAAGGGCATCCTTGAGCAGGAGAAACTGATTGCCGTGGAAAGGGACCCAAGAGGCTGTATACT GATGAACATCCATAAAAGCAAAGGTAAGGAATTCGACGGCGTGGTACTCATTGAGGGGGCATTTAAGTCCCA TTTCTTCGATGAGCGGAAGGAAGTCAGCCCCTATGAGAGGTCAGACGGCTCCTGAGAGTCGGTCTGACCCG CGCTAGGCATAGGGTGACAATCCTTAGACCTCAGGGAGCGAGGCCCCTTGTGGATCCCATCTAGTAACTCGA GGTTAACTTGT |
| 287 | 34 | GGTGTCGTGAGGATCCATGCCCAAAAAGAAGAGGAAAGTTGAGGATCCCAAGAAAAAACGAAAAGTGGGTAG CGGTAGCGTTCCAGGCGGTAGGGGACCGCTGCTCGTGCTTAACTTCCTTCCCGCTCGCTTCGACGGCCGAGT TGATGCGGGCACCCTCCCCTTCGAGACCCCTGATAAATTGAGGGCATTAGGGAGGAACTGAGAACTTCCCA TGTAGTTGTAACGCGAGGAAAAGAGGTCGTATGCGTGCCCTTCGTTAGTGGCGCGAAATTGATCGGCAAACG AACCACTATCACCGCAGCGGGACCCGACCTCGTCGTACAAACGAGTCTTCTCGAATCCAGCCTGAGGCGGAC CTTGACCGAAAAATGGAAGTACGAATTGCGCAGGGAAAACCCGCTCACCTTTGTGTCAAGGACGCCAGGAAG GGACCTGCTGGAGAAGGCCCTTGGTCGGGAGTTGCCGGGACTCCATGTGTTCCCCGCTTACAGCCTGGACGT GCGCAGATACGGTCCTGGGGGGTTCAGCGGGGTTGTTGTAGGATTGAAGACCCGCTATGAGATCGACCTGCC TGTCGGAGTGCTGCTCAGGAGGGGCGTTCAAGTAAACGGCCTTTATGTCCTGGCTGAAAGCCCCCTCGCGCC TACGTGGCCCTTCCAAGATCCCCACACCAGAAGGCGGCTCGTGGGACAAGTTGTCGCGGTGGATGGCGACAA ATTGCGAGTGAGGTGTAGGGACGGGGAGCTGGAACTTGATGCCGCCGAAGCATGGATTGAGCCCAACACTGC CAACTTCTACGCCGTCCTGCGGAAGGCGTGCGGACGCTCTTACGAACGAGACTTTCACGCCCTGGAAGCCCA AGTCGTGTCCCTGACTAACGCCCAGCAGCGAATCGCCAACAGGATCGCCGCCAACCTGATAGGCCT TGGTAAATTCGACATCAGTAACGGCTTGACTGCCGAGCTGGGGAAACCACTCAGACTGACTTCCACTCAACA TCCACACGTTCGGACTCTGGCCGAGCCCACATTTGTGTTTGACCAGAGCGGAGACAAAACCGCGCCTTTTCC CGAGACCGGGCTGACCAAGTGGGGCCCATTGGACGCTGAGAGCTTTACACCCAAGGCACCACACATCGCCGT GGTGGTTCCGCGGCAGTTTCAGGGTCGCGTCGAAACGCTGGTTGAGCGGTTCAGGAACGGCGTGAGGGGCAG CAACGCCTATGCCGAGGGCTTTGTCCGAAAGTTTAGGCTCACCGACTGTACCTTCAGCTTCACCGTTTTTGA CGGTGACGCTACTGACGCAGCCGCATATAGGCAAGCGTGCCTTACCGCCCTGAGTAATGACGAGCAAATTAA CCTCGCCTTCGTCTTCACATCAGCCGTGCAGGAGCATCAAACGGGGGACGACAGTCCCTATCTTGTCAGCAA ATCCACCTTCATGAGCCAGGGTATCCCCGTGCAAGAGTATCAAGTGGAGAACATCATCGGGGATTCAAACTT GGCTTTATCCCCTGTCCACGATGGCGCTGGCGTGCTACGCCAATAAGCGATCGAGGACGACCTATGGCACGAGAACTGATCTTCGGCATCGGGTCTGCCCAGGTAAGCGACGGAAGGATGGG CGAAACAGAGCGATTTGTGGGCATTACCACCGTGTTCAATTACGACGGTAGGTACTTGGTTAGCAACGTTAG CCGCGAGACACCCTACGAAAGGTACCCGCAAGCCCTGCTTGACGCATTGCGGACTTGCATTGCCGACGTGAA GGTTAGGCAGGGATGGAGGTCCGACGACTTTGTGCGGCTTGTCTTCCATATCTTCAAACCTCTGAAGGACAA GGAAGCACGCGCCGTAAAAGAGCTGGTGACGGAGCTGACGTCTGAATATGCCAGCGTGGAGTTCGCTTTTGT GACAGTGGTGGACGATCACCCGTGGCTGGTGCTCGATGAAAACAGCGATGGGGTTAAGGTTGGGCGAGGGAC TAAGGGCAAGCACGTAGCTCGGAGGGGTTTTGCCCTGCCGATTTCCAAAAGGGAGCTTCTTGTGACGGTTAA AGGTCCCCGGGAAATGAAATCCGATAAGCAAGGGCTCCCAAGCCCCTCTTGCTCAAGCTCCATCGCGAAAG CACCTTTACAGACATCGACTACCTGGCTTCCCAGGTCTTTCAATTCACCGCCATGAGCTGGCGCAGGCCATA CCCTACCAGCAAACCCGTGACTATAAGCTACAGTGACCTGATTGCGGGACTTCTCGGAAAGCTGCGACACGT GACGAACTGGAATAGCGACATGATCTACATGAAGTTGCGCTTCAGCAGATGGTTCCTGTAGTAACTCGAGGT TAACTTGT |

TABLE 19-continued

Argonaute nucleic acid sequences containing 2 nuclear localization sequences and a cloning sequence

| SEQ ID NO | Argonaute | Sequence |
|---|---|---|
| 288 | 30 | GGTGTCGTGAGGATCCATGCCGAAGAAGAAGCGAAAGGTCGAGGACCCGAAAAAGAAAAGGAAAGTGGGGAG<br>CGGCAGCATGCAGCAGGAGATCCAGCTTAACATCATCCCCTTCACCGCCCCTGTGGAAGAGGCAGAGTTCGC<br>TTTTTACACCGCCAAGCAAGACGGCTACTGCCCCATCCATAAGGATGACCTGAACGGGGCCATCGAAGGCCT<br>CGTGGATGAATCAGACCTGCACTACGGCAACTGGCTGTACACTGACTTCGCTCCCGCCAAAGAGAACGCCAT<br>CATAATTAGCGTCAATCTCAATGACTGTAAGTACTTCGCCCAGCACTACTACAGGCACCTTATCAGGACCCA<br>CTTCAAGGGAGTGGCCGACATCATGAGGAAGAATTTCACCAACGAAATCGAGGTCTGGTTCCACAATACCAA<br>AGCCAGCTCTACCAAGTTTAAGGTCTATAACCAGTTTACCCTCAAGGTACAGCACAACAGGGTGACGGACGG<br>ACCGGAACTTGTCGTGTCCTTCGACGGGACGACGAAGGTGCTGAACAAGTCTATCGCCGAGATACACAACTT<br>CAAAACGGAGCTTTACAACTGGATAAACTGCAACGGCGAGCTTAATCGCTGGAAATACCTGACCGACGATCA<br>GAAGCTGAATCACGAAAAGAACTACCCGGTAGTGTCAAACACACTTAAACCGCATTTCGACATTGCCTTTGA<br>CGTTCCCGATTTTAAGAACCGGTATCCCAAATACTTTCACTCTTCTGAATGACTTCTACAACAACTATCTGAA<br>TACAGACGCCTTTACTGCGATCTTGCCGCTTTCCGCTGACGGATTCTTCAAGCCAAATGGCCTGTCAGTGCA<br>GAGGATCAACGGCACTAGCAATGAGCTGCAATTCGGCAATGGCGTCGGCGTGGAGCCCAAAAGGGATCTCAA<br>GCGCCTGAAGCCGTATAAACCCGTGCCCAAACCCAGCAACGTAAAGTTTTTCTTCATCTATCACAAGCCAGA<br>TAGGGAGCATGCGGTCAAAAACATCTGGCAGTATTTCAAAGACGGATACAACGGCCAATACCCCTTCCCCAA<br>GATGGAGGAATACATATCTCAGCCCTTCGAGCTTGAGGAGAATGGATCTATCTCATTCGACAATATCGACGA<br>CGCGGTAAGCGTTGTCCAAAAAGCCATCAAGAACAAGGATCGGCTGCCCGACACTAAATACTTTGCGGTATA<br>CATCTCCCCCGTACCAAAATGGGAGAAGGACCCTAAACGGAATAGTATCTACCATCGGATGAAAGAGATACT<br>CCTGTACGAGGGGATCACCAGCCAGGTGATCTGGAAGGAGAACATTAGCAAACCGGCTTTCAACCTCTTCTT<br>GCCTAACATCGAAACCGCCATACTGGCCAAGCTGGGAGGCGTCCCCTGGAGGCTCAAGAGGGACACCACGAA<br>CGAGTTGATCGTTGGCGTGGGTGCTTTCTACTCAATACGCGGAAGTCCAAGTACGTGGGCTCTGCATTTTG<br>CTTCAATAACGAGGGCATCTTTAAGGGGTTCGACTGTTTCGGTGCCAATGACACCGACAGCATCGCGGGCTC<br>TATCAGGGAGGCCGTGGGAAAGTTCATCGCGTCTAATTACAAGGCCACAAGGCTGATCATTCACTTCTATAA<br>GGACCTGTCAAAGAAGGAGCTCAAACCAATCATCGATACACTTCACGCCCTGGGCTTGCCCATCCCAGTGAT<br>AGTCGTGACCATCAATAAAACCGAGAGCAAGGAACTCCTGGCATTTGATACCAGCTCACAAAAGCTCATGCC<br>CTACTCTGGCACCATCGTGAAGGTGGGAGCCAAGGAGTACCTGCTGTTCAACAACACGCGATACGAGGAAGC<br>ATCCGCCCAACGGATCGCGAGCACCCACTTCCCGGTGAAAATCAGCTTTTTCTCAGACAAGGCGGAGCTGTT<br>GGACGATCCCGCACTGATCAACCAACTGATCGACCAGGTGTACCAGTTCAGCCGCATGTATTGGAAAAGCGT<br>GAGCCAACAGAACTTGCCCGTAACCATTAAGTATCCCGAGATGGTGGCGGAGATTTTCCCATACTTTACCCA<br>CGATAAATTGCCCGATCATGGAAAGGAGAGCCTGTGGTTCCTGTAGTAACTCGAGGTTAACTTGT |
| 289 | 47 | GGTGTCGTGAGGATCCATGCCTAAGAAAAGAGGAAAGTGGAGGATCCGAAGAAGAAACGAAAGGTCGGCAG<br>CGGCAGCATGTATCTTAACCTCTACGAAATCAAGATCCCCTACAGGGTTAAACGATTGTACTACTTCAATAA<br>GGAGAACGACCCCAAAGAGTTCGCCCGGAATCTGAGCCGAGTGAACAACATACGGTTCAACGACAGTAAGGA<br>CTTGGTGTGGCTCGAAATCCCCGACATCGACTTCAAGATTACACCCCAGCAGGCGGAAAAGTACAAAATAGA<br>AAAGAATGAGATAATTGGGGAGAAGGAAGACAGCGATCTGTTCGTCAAAACCATTTACAGGTACATCAAAAA<br>AAAGTTCATCGACAATAACTTCTACTATAAACGGGGAAATAACTACATTTCAATCAATGATAAGTTCCCGCT<br>CGATTCTAATACAAACGTTAATGCGCACTTGACATATAAGATTAAACTGTACAAGATAAACGAACGGTATTA<br>CATTAGCGTGCTTCCAAAATTCACCTTCCTCAGTGACAAGCCAGCCCTTGAGAGCCCCATCAAGAGCACCTA<br>CCTGTTCAACATTAAAAGCGGCAAGACGTTTCCCTATATTAGCGGGCTCAACGGAGTCCTGAAAATTGACCT<br>GGGCGAGAACGGCATAAAGGAGGTCCTTTTTCCGGAGAACTACTATTTCAACTTTACCTCCAAGGAGGCCGA<br>GAAGTTTGGGTTTTCTAAGGAAATCCATAACATCTACAAGGAAAAAATCTTCAGCGGCTACAAGAAAATCAA<br>ACAGAGCTTGTATTTCCTCGAAGACATCATCAATATAAACAATTACAACCTTACCATGGACAAAAAGATCTA<br>TGTGAACATAGAATACGAGTTCAAAAAGGGCATCAGCAGAAACATAAACAGCGTGTTCAAATACAGCTTTTA<br>CAAAAATGACCAGAAGATCAAAATTGCGTTCTTTTTTAGCAGCAAGAAGCAAATCTATGAGATTCAACGCAG<br>CTTGAAGATGCTGTTCCAGAACAAGAATAGCATATTCTACCAGACCATCTACGAGATGGGGTTCAGCAAGGT<br>GATTTTTCTCCGCGAGCCGAAGACTAACAGCAGCGCATTTATGTATAACCCCGAGACCTTCGAGATTAGCAA<br>CAAAGATTTCTTTGAAAACCTGGAGGGGAACATTATGGCAATCATTATACTCGACAAGTTTCTGGGCAATAT<br>CGACAGTCTTATCCAAAAATTCCCTGAGAACCTCATCCTTCAACCCATACTCAAAGAGAAACTGGAAAAGAT<br>TCAGCCGTATATCATTAAGTCCTACGTCTATAAAATGGGAAACTTTATTCCAGAGTGCCAACCATACGTCAT<br>AAGGAACCTGAAGGACAAGAACAAAACCCTCTACATCGGCATCGACCTGTCCCACGACAACTATCTCAAGAA<br>GTCTAACTCGCCATCAGCGCCGTAAACAACTTCGGTGACATTATCTACCTGAACAAGTATAAGAACCTTGA<br>GTTGAACGAGAAGATGAACCTCGATATAGTCGAGAAAGAGTACATACAGATCCTCAACGAGTACTACGAGCG<br>CAATAAGAATTACCCCGAAAACATCATTGTTTTGCGAGACGGACGCTATCTCGAGGACATAGAGATCATAAA<br>GAACATACTGAACATTGAGAACATCAAGTACAGCCTCATCGAAGTTAACAAGTCCGTGAATATCAACTCCTG<br>CGAAGACCTTAAAGAGTGGATTATCAAGCTTAGCGACAACAATTTCATATACTATCCCAAAACGTACTTTAA<br>CCAGAAAGGTGTAGAGATAAAGATAAGAAATACCGACTACAATAATGAGAAAATACTGGAGCAGGT<br>GTACTCACTGACGAGAGTGGTGCATCCCACCCCCTACGTAAACTACCGCTTGCCCTACCCCCTGCAAGTCGT<br>CAACAAGGTCGCCCTTACCGAGTTGGAATGGAAGCTTTATATCCCTTACATGAAATAGTAACTCGAGGTTAA<br>CTTGT |
| 290 | 5 | GGTGTCGTGAGGATCCATGCCAAAGAAGAAGCGAAAGTGGAGGACCCTAAGAAAAAAGAAAGGTGGGCTC<br>AGGGAGCATGGAGGCGTACATAACGGAGATGGTGTCAGGGAGAGGGCCAACGAGCTGGAGGTTTACGTGTA<br>CGTGTTTCCACGGAAGCAATCCGACAACAACTACGAGGGTGTGTATCACATAATGAGGGCGTGGCAACGGGC<br>TAATGACCTGCCTCTGGCGTATAATCAACATACGATCATGGCATTTTCCCCGTGAGGCATATGTGTGGCTA<br>CACGCCGATGGAGACGCAGAAACGCCATATTAACATTGACTCCCCATTCGAGAGAGCCCTGCTGGAGCGACT<br>GATAAAGAACAGCCTGATTTTTACAGCCGAGCGCATTTGCATGCCAAGCGGGTAGGCCATGCGCTTCGGCT<br>GAACCAGGTGCAGCAAATCCGGCAGGTGATCATCTATGAGGCCATCGAGCTCTATGTAAATATCATTGAGAA<br>TAGAATAAGCATCGGCTTTCACCTCACCCACCCAGTTCGAGTACGTACACTCTCCAGAGCATGATAGAAGA<br>GGGAAAAACAATCAGACCTGGAATGCGCGTCGTGCATTCTAACGGAAGGCAGCATTATACCTACACCGTGGA<br>GAACGTAGCAACATATGGGGTGACCGACAGATGCCCGCTGCTGCAGACCAGCATTTACCAATACTACGTCGA<br>AAAAGGCGCGCAGCACATTTTGCGCACCTTCACCCGATCCACCAGGGTGATCCACGTAAGAACGAAAGAGCA<br>GAGGTTGAGCTACGCGGCGACACTCCTGAAACCGCTGTGTACTTTTGAGACCATGCAACCCCAGGACGTGCT<br>CAATGTCAGCAAGTGCATCAAACTTAGCGCGAGCAAACGAATGAAATGTACTTACAGGTGGATTCAGCAACT |

TABLE 19-continued

Argonaute nucleic acid sequences containing 2 nuclear localization sequences and a cloning sequence

| SEQ ID NO | Argonaute | Sequence |
|---|---|---|
| | | CCGGGCACAGTACCGACACCTGACCTTTGCGCCGAACCCCTTCACGATCGCCCAGAATGGCTATAAACTTGA<br>TCAGCTCAGCACCCCCAAGGTGCACTTCCACAGAGACTACGCCACCGTCGTGAGCGGAATGAAGACCGGCAA<br>GCTTTACAAAGGCGGTAATATCAAGATCAGCGTGCTCTTCGACGAGGACTTTTACTTGAAACACCACATCAC<br>CAAGAAGGACATATATCAATTCATTGCAGTCCTGCAGAAAATCGCCATCGCACAAGGCGTGAACATGACCAT<br>AAGCACGAGCACCAAGTCCATTACGGGCAAGTTCACGGACGACTTTTTCCACCACTTCACCGAGGAGGTCGA<br>AGCACTGCAGCCCATCTTCGCGCAAACCACAGTTCTGGCATTCATTACCAGTACCCACCTGAGCAACAAGAA<br>AACCAGGAGTTACCAGCTGCTGAAACAGTACTTCGGCGGCAAGTGGGACATTGCCTCTCAAGTCATCACGGA<br>GAAGACGATTGAGGCGTTCCAAAAAATCTTGCACAAGCACGGCCTGAAGAATTTCTACCCCAATGACGAACA<br>GCACTGTCTCCGCGTGATCGATGTCCTCAAGAATGAGAGCTTCTACTACACGGTCATGAACATCCTCTTGGG<br>AGTATATGTGAAAAGCGGCATCCAGCCCTGGATCCTTGCTAATACAACCCACTCAGACTGCTTCATCGGCAT<br>CGACGTTAGCCACGAGAACGGAAACTCTGCGGCTGGGATGATGAATGTTATCGGCAGCCAGGGCCACCTTAT<br>CCAACAGGCGCCCCTGAACGGCATATTGGCGGGAGAAAAGATTGACGACACCCTGCTCGCAAACTTGCTTAA<br>ACAAATGATTAAGGCATACCACACCCAGTTCCAGCGCTTTCCCAAGCATATAACAATCCACAGGGACGGCTT<br>TTGGAGAGAACACACTGCACTGGTCGAGAAGATCATGAGCCACTATGAGATTACCTACGACATCGTCAGAT<br>CATCAAAAAGCCTAATAGGAGGATGGCTTTCTTCAACAGCGTGGACAACACCTTTAGCACCAGGCAGGGGAC<br>AGTGTACCAACGGGGCAACGAAGCCTTTCTGTGCGCCACTAACCCTCAGCAGAAAGTGGGCATGGCACAACC<br>AATCAAAATACATCAGGTGACCAAGACCCTGCCCTTCTCACACATCATAGAAGATGTCTACAACCTCAGCTT<br>CCTTCATATTCACGCTATGAATAAGATGCGACTGCCGGCCACCATACATTATGCCGACCTGTCTGCCACCGC<br>TTACCAGAGGGGCCAAGTGATGCCCAGGAGCGGTAACCAGACAAATCTGCCTTTCGTGTAGTAACTCGAGGT<br>TAACTTGT |
| 291 | 45 | GGTGTCGTGAGGATCCATGCCTAAAAAGAAGAGGAAAGTAGAAGATCCAAAGAAAAAGCGAAAGGTGGGAAG<br>CGGCAGCATGACCGGCGAGACTAAAGTGTTGGTCGGGAGGCAACCCTTCGACGTGGATCGGCTGAATGAACT<br>CAGAGACGAATTCCGGGAGACGCACGTGTTCAGAAGGGATGGCATCGACGATGTCATTGTTGATGTTCCGGT<br>CGTGGCCGGACAGAAGCCCATCGGCAACGTCCAGGAGGAAATAGACCTGGCTAGGTACCAAAAGGTGTGGCC<br>CTCCCTCCTCAGTGCTGCTCTTGTCCGGGCGTTTAGCGGCGTAAGGGACATCCTGAGCGATAGGCCCGTGAG<br>CGTGGTGGGGAGCACACTGCGGGGTCTGGTTCAACATCCGGAACTCCCCGAATGGATGCAGAAACGCACACT<br>CCTTAGGTTCGACACCCGGACCATCTATGCTGGTGATAAAAGAACCTTTGGCTTGGTGTGCGAGGCCAGATT<br>GAAAAAACCTTATCCAAGGTAGTTGCGCGGAGCTGCTGGCACTTGGAGTTTCCCCACTGGGTCGATATGTCCA<br>AGTCGAGGAGCCACATTACGATCCCAGGCTTATGAAAAAACGGCGCCTTGTGGGCAGGGTATCAGCGATCTC<br>CGGCGATAATCTGGTGCTGGAGGACCATGCCGAGGGCTTTCCGACCGTGAGTGCAAAGCTGGCATTTCTGGA<br>GGCGCGAAGGGAGATTTTTGACGACTGTGTGCGGAGGATTTTGAACTCTGATGCGGCCTCCGTGCTGAACAA<br>GGCCGAAGCTACTGCTGCCTCATTTCACTCAGGGCCAGGTAGGAAAGAGCAAATAGAGGAGGCTCTCAAGTA<br>TCTCAGGGAGAAGGTGAGCCTCGAAGCTGTACCCGGAGCGAAATTCGTGATCGGGCCGATGCTGAGTAGCGG<br>CAACAAGGGCTTCCCCATCACGGAGATGATCCCGAAACCCATTCTCGTGTTCGATCCGAGCGGTACACGGAA<br>GGATGAGTGGAACGAAAGGGGCATTAAGAAGAACGGGCCCTACGACCAGAGGACGTTTTCACCTAAGCAGTT<br>GAAGGTGGCGGTCATTTGCCAGGCGAAGCACGAGGGGCAGGTGGATGGATTCATCGCGAAGTTCTTGGAAGG<br>TATGCCAGACGTTATGACGGGCAAGAACCGAGTTGCTAGATATGGTGACGGTTTTCTGCGGCGATTCGCCCT<br>TGAGAAACCTTCTGTGACCTTCTTCACAGCGCCCTCAGCCAAGGCGAGCGATTACCTGGTGGCCAGCCGGGC<br>TGCGCTGACCAAGGCAACGGACGAGGGTTTCAAATGGGAACTCGCGCTTGTGCAAGTGGAGGAGGAGTTTAA<br>GGGATTCGACGACGAGAGCAACCCCTACTATGCCACTAAATCCGTCTTCCTGAAGCGAGACGTGCCGGTCCA<br>AAGTGTACGACTCGAAACCATGGCTCAGGCCGACAGCCAGCTGATTTTCTCTATGAACCACATGAGCCTGGC<br>GACATACGCCAAGCTCGGTGGTACCCCCTGGCTTTTGGCGTCACAGCAGACGGTAGCGCATGAACTGGTTAT<br>CGGTCTTGGCAGCCACAGCGTGGCCAACAGCAGGATCGGTAGCCAGCAACGATTCGTCGGGATTACGACGGT<br>GTTCTCCTCCGACGGGAGCTATCTGCTCTCAGACCGCACGGCGGTTGTCCCCTATGAGGAGTATGCGACTGC<br>GCTTTACGATACGCTCAAACGGAGCATCACTACGGTGAGGAAACAAGACAACTGGAGGTCTACGGATAAAGT<br>CCGCCTGGTGTTCCACATGTTCAAGCCCCCAAGGACACCGAGGCCGAGGCTATAAAACGGACAGTGGACGA<br>TCTGGAGCTGGAGAACGTGACTTTCGCCTTCGTCGACATCGCCCCATCTCATCCCTACCTCATCTTCGACAA<br>TACACAAAAGGGAATTGGTTTCCGAGACCCCAAGAAGGGGATACTCGGACCCGAGAGAGGTCTGCACTTGAA<br>GCTGGGGGACTACGAGTCCTTGATCGTATTCAGCGGCGCAAGCGAGCTGAAACAGGCAAGTGACGGGATGCC<br>CAGGCCATGCCTGCTCAAGTTGCACCGGCTTAGCACGTTCACTGACATGACGTATCTGGCGCGACAGGCATT<br>CGAGTTTTCAGGTCATTCATGGCGAATGCTCTCCCCAGAACCGTTCCCTATAACTATTAGGTACTCCGACCT<br>GATCGCCGAAAGGCTCGCAGGTCTCAACGCCGTCCCGGGTTGGGACGCGGAGGCTGTCAGATTCGGCCAAAT<br>CGGCCGCACGCTCTGGTTTCTGTAGTAACTCGAGGTTAACTTGT |
| 292 | 42 | GGTGTCGTGAGGATCCATGCCCAAGAAAAGAGAAAGGTCGAGGACCCGAAGAAGAAAAGGAAAGTGGGCAG<br>CGGCAGCCTGAAAATCAAAATTCTCAAGGAGCCGATGCTGGAGTTTGGCAACGGCGCTCACATATGCCCCAG<br>GACCGGTATCGAAACCCTGGGAGTGTACGATAAGAGAGATGAACTGAGGAGGAGCGAGCTGCGAATAGGCAT<br>TGTGGGTCGGGGCGAGGGCGTGGACCTTCTGGATGAGTGGCTCGACAAGTGCAAGCGCGGCATCGTGGGTAA<br>AGAGGAGACCAAGTTCCCCAACTTGTTCAGGGGCTTTGGGGGCGTCGATGAGTACCACGGTTTCTACACCAA<br>GATTCTGAGCAGCCCCCAGTATACCCGGACTTTGCAGAAAAGCGAGATTAACAACATCAGCAAGATCACCGC<br>CCGAGAGGACAGGGTAGTGAAGTGCGTGGAGCTGTACTACGAGCAGATCCGATTCCTGTCAGAGAACAGGAG<br>CATTGACGTGATCGTGTGCGTCGTTCCCAATGATATTTTCGACAGCCTTACTAAGGCCACCGGAGACAAAGA<br>CACCGAGTCCCTGGAGGCCTACCTCGAGCACAACTTTAGACGGTTGCTCAAGGCCCGCTGTATGCACCTTGG<br>GATACCCTTGCAGCTTGTGAGGGAGAAGACCATCCTGAGCGTGAAGTTGCATAGACCAGCAGGACCTTGC<br>CACAAAGGCTTGGAACTTCTGTACGGCCCTCTATTACAAGGGGAATAGGACTGTACCATGGCGCCTGGTGGA<br>GGATAAATTCAAGCCTAAGACCTGCTACATCGGCATTGGGTTCTATAAGAGTAGAGACGGCAAACGGTGAG<br>CACATCACTTGCACAGGTATTCGACGAGTTCGGCCACGGGGTCATCCTTCGGGGAGCACCAGTTAGCCTGGA<br>CAAACGAGACAAGAGGCCCTACATGGACGAGTCTCAGGCTTACGAACTGCTGGACAGTGCCCTGGCGGAGTA<br>CGAGAAGGCCCTGATGCAAAAGCCCGCTGAGTGGTGATCCAAGAGCAGCAGGTTCCGGCCCACCGAGGT<br>GAGCGGCTTCAGCAGAGTGCTGAACGCGAAAGGAATCAGAACGAAGGACCTCGTGAGCATCACATCAACCGA<br>CATCCGCCTGTTCAGCGACAAAAACTATCCCCCACCCGCGGTACCTTGTTGTCCCTGTCTGAAACACAAGG<br>AGTACTGTATACCAAGGGAATCGTAGATTTTTACAAGACCTATCCGGGCATGTATATCCCTTCACCCCTGAG<br>GGTTGAGGCGTTCGAGTCCGACAGCTCTCTTGAAGACTTGTGTAAGGAAATCCTGGGCCTGACCAAAATGAA |

TABLE 19-continued

Argonaute nucleic acid sequences containing 2 nuclear localization sequences and a cloning sequence

| SEQ ID NO | Argonaute | Sequence |
|---|---|---|
| | | TTGGAACAACACACAACTGGACGGCCGACTGCCCATTACCCTGGAATGCGCCAATAAGGTGGGCGATATCAT<br>GAAGTATGTGGACGCATCCGAAAAGCCACAGGTTGGTGTGGCGCTGTTTTATCTTCATGTTGGAGCAACTCGT<br>ACCCGGCTGGAAGCTGCCTAAGGTGAGTACATGGGTAGCACGGGTAATTTTCCTGAATATTGTACAGGTGTC<br>TATCGCTCTGCTTGCCGGGATTACTTGGAATAAATGGATGATGGGCCACAGTTTGTTGCATACCAGCGATGC<br>CCTGCCCCCTTGCTCGCAGGATTCGCCGCCTACTTCGTTAACACCTTCGTGACCTACTGGTGGCACAGGGC<br>CAGGCACGCCAACGACACCCTTTGGCGACTTTTTCACCAACTGCACCATGCGCCCCAGAGGATCGAGGTGTT<br>TACTAGCTTCTACAAACACCCAACGGAAATGGTATTCAACTCTCTTCTTGGCAGTTTCGTGGCCTACGTCGT<br>TATGGGGATCTCCATCGAAGCTGGCGCGTATTACATCATGTTTGCGGCTCTTGGCGAGATGTTCTACCACAG<br>CAACTTGCGAACACCGCATGTTCTCGGTTATCTCTTTCAACGCCCTGAGATGCACCGGATCCACCACCAGAG<br>GGACCGACACGAGTGCAACTACAGCGATTTCCCCATCTGGGACATGTCTTCGGCACCTACGAAAATCCCAG<br>GAGAATAGACGAACCACAGGGGTTTGCCGGCGACAAGGAACAGCAATTCGTTGATATGCTTTTGTTTAGGGA<br>CGTGCATTCCCTCCCCGGGAAGACACAACCAGCTCCCGTACTCGTCAAACCCGACGTGAGGTAGTAACTCGA<br>GGTTAACTTGT |
| 293 | 78<br>(Helicase) | GGTGTCGTGAGGATCCATGCCCAAGAAAAAGCGGAAAGTCGAGGATCCAAAGAAGAAGCGCAAGGTGGGTTC<br>CGGGAGCAAAGGGCGGCACCAGGCGAAACACTACGCGGACGGCCTGGAAAAAATGCACGGGCAAAGGCCTGT<br>GATTTTCTACACCAACGGCCACGATATATGGATATGGGATGACCATCCGGCTCAGCACTACCCGCCCAGACG<br>GTTGTACGGATTCTACGCGAAGTCCAGCCTGCAGTATTTGATAAGGCAGCGCAGTGAACGCAAGGCGCTGAA<br>TACGGTGAGCTCTAAAACCGATATACTCGGAGAAAGACTCTACCAGCACGAGGCACTGAAGCGGATCTGCGA<br>ACGCTTCGAGACCAAGCAGAGGAAGGCACTCGCAGTCCAAGCGACCGGCACGGGGAAAACCCGCTTGTCCAT<br>CGCACTTACTGACTCTTGCATGAAGGCCGGGTGGGTGAAAAGGGTGCTTTTCCTGTGCGACCGAAGGGAACT<br>TAGAAAACAAGCTAAGAACGCCTTTAGCGAATTCCTCAGCGCGCCTATTAGCGTACTGACAACGAAAAGTGC<br>GCAGGATACCCACAATAGAATCTTCGTGGCAACCTACCCCGCGATGATGAAGGTGTACGAGCAACTGGATAC<br>GGGATTCTTCGACCTGATCATAGCCGACGAGAGTCACCGAAGTATTTACAACATCTACGGCGACCTCTTTCG<br>CTATTTTGACGCCCTTCAAGTGGGCCTGACCGCAACCCCCGTGGAGATGGTATCTCGGAGCACCTGCCAGCT<br>CTTCGGGTGTGACTTTAAGCAACCAACTTCTAATTACACACTCGAAACGGCTGTGGAGGAGGGTTATTTGGT<br>GCCCTACCAAGTCGTGAAACATACCACAAAGTTTCTGCGCGATGGGATCAAGGGCCACGCGCTTAGCGCGGA<br>GGAACTGGCGGAGCTGGAGGACAAGGGCATCGATCCTAACACTCTTGATTTCGACGCCGAGCAGATCGACCG<br>AGCGATCTACAATAAAGACACCAATCGGAAATCCTGCAGAACCTCATGGAGAACGGTATCCGGCAGGCCGA<br>TGGCCAGACCCTCGGTAAGACGCTGGTATTTGCTAGGAACCACAAGCACGCCAAACTCCTCGAACAGTTGTT<br>CGACGAGCTGTACCCCCAGTACGGCGGTAAGTTCTGTCAGGTTATAGACAACTACGACCCCAGGGCGGAAGA<br>GTTGATAGACGATTTTAAGGGCGAGGGCAGCAACGAACAGCTCACTATAGCAATCTCAGTCGACATGCTCGA<br>CACCGGGATTGACGTCCCGGAGATCGTAAACCTCGTATTCGCACGGCCGGTTAAAAGCCCCGTGAAATTTTG<br>GCAAATGGTTGGTCGGGAACGCGACTCTGTAAGAATTTGTTTGGACCCGGCAAGCACAAGACGCACTTCCT<br>TATTTTCGACCACTGGGGAGTCGTGGAGTATCACGGCATGAAACAACGCGAGGTAACTGTGTCCCAGAGCAA<br>GTCCCTGATGCAGCAATTGTTTGAAAATAGATTGGAGCTCGCCAAGACGCGTTGCACCACGCCGAAGCCGA<br>CTTTTTTGAGACGATGGCGGGGTGGCTGCACAAAACGATAAATAGCCTGGACGATCGAACGATTGCCGTTTG<br>TGATAAGTGGAAAACTAAGCAGCAAATGTCCGACCTGGAGACGCTTAGACAGTTCGGTGCAAACACCGTCAC<br>GCTGCTTGAGTCAGAAATCGCCCCGTTGATGCAATGGCTGGATGTCAGAGGGCATAGTGACGCATATCAGTG<br>GGACCTCCTGGTCTCACAGATCCAACAACAAAAATTGAAGCAGGCGGCAGCCTTCGATGATCTCGCTGGGAG<br>GGCAATCAATCAACTGTGGCAGTTGCAGATGAATTTGAATCAAGTTAAGGCAAAGTCCGAGTGGATTAAGCA<br>GTGCCGAGAGACGGAGTGGTGGCAGAAGGCGTCCCTGGATGAACTGGAACAAATGCGACAAGAACTGCGGGG<br>CATTATGCAGTACAGGAACAAGGGTGACATTCCGAAGACAGAGGCGCCCATCATAGACATAACGGACTCAGA<br>GGAGGTGCGCGAGAAACAATCCTCCTACCTGAACTCAGTTGACATGGTCGCGTATCGGGTCAAGGTTGAACA<br>GGCGCTCCAGGAGCTCTTTGAGAGAAACCCCATCCTTCAGAAGATCCGGAACGGGGAGGCCGTGTCTGAGCG<br>CGAGCTTGAGAACTTGAACGCTCTCGTGCATACACAACACCCGGATATCGATCTCAACACACTTAAAAGTT<br>CTATGGGACCGCGGCTCCGATGGATCAAATCCTTCGGACAATAGTAGGCATGGACGGGAACACGGTTAATCA<br>GCGCTTTGCGGCGTTCATACAACAGTACCCCTCACTGAGTGCGCGCCAAGTTCAATTCCTGTCCCTGCTGAA<br>ACGACAAATTGCTCAGAGTGGGGCCATAGAGATTGACAACTTGTACGAAATGCCATTCGCAGCTATCGGCGA<br>ACCCGACAGCGTATTTAGTAACGCGGAACAGATTGATGACCTTCTGGCGATTGTGGAGAGCTTCGGGAAGCA<br>GCCCCAGCAGCAGTCTACGAGACAGGCCAATGAGACATAGTAACTCGAGGTTAACTTGT |
| 294 | 64<br>(Helicase) | GGTGTCGTGAGGATCCATGCCTAAGAAAAAACGCAAAGTAGAAGATCCTAAAAAGAAGAGAAAGGTCGGCTC<br>CGGGAGCATGGATTACATACTTGAATTCGACGAGTTTATTCGAAGCATCAAGCAGAATATTGATACAAAGTA<br>TTCATTCCTGTTGGGGGCTGGCGCTTCAGTCGAATCAGGTATTCCGTGTGCCAGCGAATGCATCTGGGAGTG<br>GAAGAGGGATATCTTCATCAGCCAAAATCCGACCCTGGCTGAGATGCACAACAACATCAAGAGCCAGAACAT<br>TAAGCGCAGCATCCAGAACTGGCTCGATAACCAGGGCACCTACCCAAAGGAGGGCGAGGACATCGAGTATTC<br>CTACTATATTGAGAAGGCTTTCCGGATTCCCGACGACCGGAGGAAGTATTTCGAACGAAACATCACCGGCAA<br>GACTCCGTCACTGGGCTACCATATCCTGTGTCTGCTGGCGGAACGCGAGATAATCAAGTCCGTTTGGACAAC<br>AAACTTCGACGGCTTGATCATTAAAGCCGCCCATAAGTACCAGTTGGTGCCCATCGAGGTCACCCTCGAGAG<br>CCAAGATAGAATCTATCGGACGGATGCCAACAAGGAGTTGCTTTGCATAGCCTTGCATGGGGACTACAAGTA<br>CGGTCCGCTGAAGAATAGTAAAGAGGAGCTGGACAGCCAGTCTGACATCTTCGTGAATGCCCTTCCTTCGA<br>GGCGTCTAAGCGCTATTTTGTGGTGATGGGATACAGTGGGCGCGACAAAAGCCTCATGCAGGCTATTGAGCG<br>AAGCTTTTGCAGAAGCGGCGCTGGCCGCCTTTACTGGTGTGGATACGGCCGGAACATCGCGCCTGAGGTACG<br>CGTGCTGATCGAGAAGTTGAACTTGTATGGACGCGAAGCGTTCTATATTCCCACCGGACGGGTTGACAAGAC<br>GATGTTGAACATAGCCCATATGTGTTTCGAGGATAAGGAATTGCAGGAAGAAGTGGAGAAACTCAAAGCGGA<br>TCTCGGTGCGGGTATGAGTGTCGCACCACCACGTTCAGCCCCTACAAGGAAGGGTGAATAAGATCGTGGA<br>CACAAATGTTTACCCGATCAAATTCCCCGACAAGTGCTATCAGTTCGAGGTGAAGAACAGCAGCGTAATGAA<br>CCTCTGGGATTACTGCAAGCAGCTGATAGACTATAACATTGTGGCCGTCCCCTATAACGGGAATGATCTACGC<br>CTGGGGAAACCGCAACAGCATCAGCAACATGTGCGGACCAAATGTGAACGGGACGATCGAACTCGTTCCTCT<br>CACTAGGAAAATCTTTTTCGACAACGGCACTCTCAAGTCAATGCTCCTTAAAACTTTGCTCATCGTGATTGG<br>AAAGCACTCCAATTGCAAGTATAACCGAAACAAAATCTGGCGAGAGTCCAAGAAAATCAACTACACTATTAA<br>CGGCAAAAACATTGAAGCGTACCAAGGCATTAGGTTTAGCTTGTTCATGGACTGGAAATACAGCTACCTCAC<br>CCTGACCCCCGCTTTCTACTACAAAGACAGGAACAACGTTAGCAAGGAGGAGAACAAAGAGTTCAGCGACCG |

TABLE 19-continued

Argonaute nucleic acid sequences containing 2 nuclear localization sequences and a cloning sequence

| SEQ ID NO | Argonaute | Sequence |
|---|---|---|
| | | GTTTATGGAGCAAATATGTAAGATGCAAGCCAATAAGAATTACGCCGCGTACATAAAACACTGGATTAACAT<br>TATCTTTCCTGATGGCAAGTCCATCATTTCCATGTACCCGTGTAACAGCGAGAGCGGATTCGAGTTCACCAT<br>TGTTAATAAGTCACTGCTGGTCGGACTGCGGAGTAGGCAAGCACTGCATAATCCTGACGATGACATGAAGAA<br>ACGGATTTGCATCGGTGGAGCTGAGTTGGCGACACCGAGCTCAAGTTCTACAATCCGGCTCAGAATGCAAT<br>GCACACCGACTTCCACCCCATGAGGGGCCTTATCAACAATAAGCCCTACGACTTCTACATGAATAACAGGCT<br>GTTTAAATCTTACATCTCCCTGGGCGTGATCTCTCCTGTGGGTTCAGAGAAAAAGCTGGAGGACTTCCTGGA<br>CCGACTCAACAAAAAGCACAAAGTGAACTACAACGTCGACTATGTCATAGATTATCCTGGGTTTCAGTCCGT<br>CTACGGGGTTGGCCTTTCTGTCCCTCTGATCGCAGAATGGGCGTTGTTGGATGATAAAATGCTGAATAAAGC<br>CAACCTGTATCAGAGCTGCCTTAACTTCGGGGATCAGATCAAGAAGAAGATTGAGTACCTGAAGAGCCGCGA<br>CAGCGTGGACGTGATCATCATATACATTCCGAAAGAGTACGAGCTGTTCACCTTCTTCAACGACGGAAATAT<br>CCATTATGACCTGCACGACTACGTGAAAGCATTCAGCGTGCAGAGGCACATTAGCACCCAGTTCATACGGGA<br>GAAAACAATTGACTCTGAGCTTGACTGCCAGATCGCGTGGGCCCTCAGCCTCGCTATCTACGTTAAAGCAGG<br>CCGCACTCCGTGGATTCTCAGTGGCTTGAGGACTGATACCGCCTTCGCCGGCATCGGCTATAGTGTGGACCA<br>TATAAAGACCGACAACCAGACCCTTATCGGCTGTAGCCATATTTACGGGGCAGATGGCCAAGGTCTCCGGTA<br>CAAGCTCTCCAAGATTAAGGATGTGACCTTCGACAGCAAGAACAATCCCTACCTGTCCGAAAACGAGGCCTA<br>CCAACTCGGCCTGAATATCAAGGAACTTTTCTTTGATAGCTTCAAGACGTTGCCCCAACGAGTGGTCATACA<br>CAAAAGGTTTCCGTTCCAGAAGCAGGAGATCGATGGCCTGACTAAGTGTCTTGGGTCCGCGGGAGTGAAAGA<br>CATAGACCTCATCGAAATCACCTTGGAGGATCGATTTAGGTGCTTTGAATACGACAGGCGACTCCAGATTGA<br>CGGCTACCCCGTGAGGAGGGCGTGTGCTTCGCCATCAACGAGACACCGCTATCTGTACACCCACGGTAT<br>TGCACCAAGCGTCAAGAATGCCAATCTCCGCTACATACAGGGCGGTAAGAGCATCCCTGCCCCCCTGAAAAT<br>CGTTAAGCACTACGGGAACGGCGACCTGGCCCAAATTGCGACAGAGATCTTGGGCCTGTCAAAGATGAATTG<br>GAACAGTTTTGGTCTGTATAGCAAGCTTCCGTGCACTATCCAATCTAGCAACGCTATCGCTCGCGTAGGGTG<br>GCTGCTCTCCCAGTATGAGGGCGTAGTTTACGACTATAGGAATTTCATGTAGTAACTCGAGGTTAACTTGT |
| 295 | 70 | GGTGTCGTGAGGATCCATGCCAAAGAAGAAACGAAAGTGGAAGACCCCAAAAAAAAGCGGAAGGTGGGCAG<br>CGGCAGCATGAACAATCTGATGCTGGAGGCGTTTAAGGGCATTGGCACCATCAAGCCCCTGGTGTTCTATAG<br>GTACAAGCTCATCGGCAAGGGGAAGATTGAGAATACCTACAAGCGATCAGCAACGCCAAGAATAAGATGAG<br>TTTCAATAACAAGTTCAAAGCGACGTTCAGTAAGGGAGAGACCATCTACACCCTTGAGAAATTCGAGGTCAT<br>GCCCAATCTTAACGATGTGACCATTGAGTTCGACGGAGAAGAGGTTCTCCCGATAAAAGACAATAATGAAAT<br>TTACTCCGAAGTCGTGCAATTTTACATCAACAATAACCTTCGAAAGATCAAACTGGATAACAAATATCAGAA<br>GTATCGAGCAACGAATACCAGAGAGATAACTGGCAACGTCATACTCGACAAAGACTTCAAGGAGAAGTACAA<br>GAAGTCTAAGTCAGGGTTCCAGCTCAAGCGCAAATTCATAATTTCCCCCAAGGTGAACGACGAGGGTAAGGT<br>AACCCTGTTCCTTGACCTGAACAGCAGCTTCGACTATGACAAAAACATTTACCAGATGATCAAGGCCGGGAT<br>GGACGTGGTGGGGCAGGAAGTGATTAATACGTGGAATAATAAGAAGCAGAAGGGCAAGATTAAGAAGATTTC<br>TGAGCTGACGATCTCAGAGCCTTGTAACTTCGGCCAGTCCCTTATCGATTACTACGTTTCCCTCAACCAAGC<br>TGTGAGGGTGAAGAACTTTACGGAAGAGGAAAAGAACACAAACGTTATCGTCGTCCAGGTGGGAAAGGGCGA<br>GGTTGAGTATATTCCGCACGCGCTCAAACCCATCATTACTAGGGAGTACATAAAGAAATACGATGAGGCCTT<br>CAGCAAAGAGGTAGAAAACCTGATCAAAATCAACATGTCATACAGGTACGAAATACTGAAAAAGTTCATCGA<br>CGACATCGGCTCTATAACCGAACTGAACAACCTTAAGTTTGAGAACACGTACATAGATAACATCGAGTCACT<br>GGGCTACCAACAGGGAAAGCTGAACGATCCCGTGCTGATAGGCGGCAAAGGCATCCTGAAGGATAAGATACA<br>TGTGTTCAAATCCGGCTTTTACAAAAGCCCCATTGACGAAGTCAAGTTCGGCGTGATTTACCCGAAAGGCCA<br>CACCAATGATAGCAAGTCCACCATCCGGGCGATTTATGATTTTTGTACCGACGGGAAATACCAAGGCAAGGA<br>CAACATCTTCATTAACAACAAACTGATGAATATCAAATTTAGCAACCAGGACTGCGTGTTTGAGGAGTACGA<br>GCTCAATGACATAACGGAGTATAAGCGAGCCGCGAATAAGTTGAAAAACAACGAGAACATCAAGTTTGTAAT<br>CGCCATCATCCCCGCGATTGATGAGAGTGATATAGAAAATCCCTACAACCCTTTTAAGCGGGTCTGCGCCGA<br>GTTGAATCTGCCCAGCCAGATGGTAAGCCTGAAGACCGCGAAAAGATTCGGCACCAGCAAGGGTAATAACGA<br>GTTGTATTTTCTGCATAACATTAGCCTGGGTATCTTGGGTAAGATAGGGGGGGTCCCTTGGGTCATTAAGGA<br>CATGCCTGGGGAAGTTGACTGCTTCGTGGGCCTGGATGTGGGCACCAAAGAGAAAGGGATCCACTACCCCGC<br>ATGCAGCGTCCTTTTCGACAAGTACGGCAAGCTGATTAACTATTACAAGCCCACAATCCCGCAGAGCGCGA<br>GATCATCAAGACAGACGTGCTGCAGGAGATCTTCGATAAAGTGCTGCTGAGCTACGAGGAGGAGAACGGGCA<br>GTATCCTCGAAACATCGTGATTCACAGGGACGGGTTCAGCAGGGAGGACCTGGAGTGGTATAAGAACTACTT<br>CATCAAAAAGAATATAAACTTCACGATTGTAGAAATCAAGAAAAACTTCGCCACCCGCGTCGCGAACAACAT<br>AAACAATGAAGTGTCCAACCCATTTAAAGGGAGCTTCATACTGCGCGAGAACGAGGCCATCGTTGTAACCAC<br>CGACATCAAAGATAATATCGGCGCTCCGAAACCAATCAAAGTCGAGAAGACATACGGCGATATTGACATGAT<br>GACCATAATCAACCAGATCTACGCCCTCACGCAAATCCACGTCGGAAGCGCGAAATCTATGAGGCTGCCGAT<br>CACGACCGGCTATGCCGACAAAATATGTAAATCCATCGAATACATCCCGAGCGGTAGGGTGGACAACCGGCT<br>CTTCTTCCTGTAGTAACTCGAGGTTAACTTGT |
| 296 | 61 | GGTGTCGTGAGGATCCATGCCGAAGAAGAAGCGAAAGGTCGAGGATCCCAAAAAGAAACGGAAGGTTGGCTC<br>CGGGTCTATGGGCAGGCAACTCCAACTGAACTTTACCCCGCTCAGGGTTAGGGGCGACGCCATCAGACTTCA<br>GGCGCTGCCTTTCGAGGACGCTCAACAATTTAGGAATCTGCGCGATGAGCATCGAGCACACTACGCTGTGAC<br>GAGAAGGAGCGACCACATCGTGGCCCTCCCACTTACACTGAATGCCTCCCCAATCGGCGAGGAGAAGATCGT<br>GAGCGTTGTGGAGCATGCGAGTTTGATTCGGCCCCTGCTTGAACAGAGGTTGGTGACCCTTCTGTCCAGTAA<br>CCGGAGGCCGGTGGCCCGGTATAATCCGATCACCACCATTGGAAGAACCTTGCCAACGGGCTTCATAGAAGC<br>CGACCGACACCTCCATTTGCAGTCCCGCGTGCTTATTGCTATCCGCTCCCTCAAGCTGCCGAGCGCGAGCC<br>CTTGGGATTGCTCTGGGACATCGAAATCCAGAAAACATGCGCGACTAGCCTTGCCGTCCTGCACGCACAAGG<br>GGTACGGCTGGACGGTCTCACAGTGGAACGGCTTGTCCCGGTGGAGGACGTGCGAATGTTGCCTTATAGGCG<br>ACTGGTGGGCAGAGTAGGCGCGCTGACCGATGGCCACGCCCGATTGAGCGAGCGGTTCCAGAACGTCGAAGA<br>ATTGCTGCCCCTGGACGAGCTTTACCTGGAGGCCAGTCCGGAGAACCTGAGGCACCTTCTGCAGCATTTCAT<br>GCGCAACACAAGCGGGCGAGTGCAAGGGAAGATAGACGAGATCGTCTTCGAGAACTCACGGGACGCGCTCG<br>GATGGAGCACATTGCCCGGATCTCCGACTGGCTTAGAGGCCTGGGCGAGATTGAACTGCAGGAGGGTTTGTC<br>TGTAGGCATCGGAAACCTGCTCTCTGAAAAGGACGCCCAGAACTTTCCCAGGTTCACTGAGGGAACGACCCC<br>AACCTACGTGTTTGACGCTGGGACGTTGAAGAGCGAGTCAAGGGCCGCAGTGGGCCTCAGTAAATTCGGGCC<br>CTACAGCCGGCATGTATTTACACCGACTCGACCCAACGTTTGCGTCATCTGCGACCGCGCAAGAAGAGGACA |

TABLE 19-continued

Argonaute nucleic acid sequences containing 2 nuclear localization sequences
and a cloning sequence

| SEQ ID NO | Argonaute | Sequence |
|---|---|---|
| | | GTTTGAGCTGTTCCTGCGGAAATTCCGGGATGGCCTGACTGTTGATGGGAAGTCCCTGCCGTTTGGTCGCGG
GTTTCTGGGAATATATGGCCTTCAGGATATCAACCTGACCTTCGTCGAGGCGGATGCATTCACCGCGGACGC
GTACCATGCTGCCGCAAGCAAGGCAGTACGGATGGGAGCCGAGGGCGCACCGTTGGCACCTGGCACTCGTGCA
AACAGAACGCGACAGTCGGCAACTGGCTCCCCCCAAGAATCCGTATTTGGTAGCGAAGGCGGCGTTTCTGTC
TAATCAAATTCCTACCCAGTTTGTGGCGTTCGAGACATTTTCTATGGCGCCTCTGAACCTCGCGTACACACT
GAGCAACCTGGCGTTGGCGGTTTATGCCAAGTTGGGCGGCATCCCATGGCTGATCAAGAGTGATAAAGGTAT
AGCCCACGAGGTCGTCATCGGGTTGGGTAGTGCCGCGATCGGGGAGTCCCGATTCAGCCGGAAGGAGGAGGAT
TGTCGGCATCACAAGTGTTTTTCGGGGTGACGGCGGGTACCTCTTGTCTAACCTGTCCAATGCCGTGCCCAT
GAGCAAGTACGGCGAAGCATTGACCGAATCTCTCCAGGCGACCCTGCAGAGGGTTCGCAATGAGATGAACTG
GATCAGGGGGACAGCGTTCGGGTCATAGTTCACGCTTTCAAGCCAATGAGGAACACGGAGGTGGAGAGCGT
TAAGGCTGCGCTGAAAGAATTCAGCGAGTTCGACCTGCAATTTGCTTTCCTTCACGTTAAGCAAGACCACCC
GTACCTCCTTTTTGACGACGACAGCATCGGTACAAAAGGGCGAGGCGAGAAAACCCCCGTGCGAGGCTTGTT
CGCGGAGGTCGGACACAACGAGACACTGCTGACCCTGACCGGACCACAGCAGCTGAAGAGACCCACCGACGG
GCTGCCGAAACCGCTTCTGCTCAGCCTCCATAGGGACTCTACTTTCACAGATATAATCTACCTCACGAAGCA
GGTGTACTGGTTTAGCAATCACTCATGGCGGTCTTTCCTGCCAGCAGCGATGCCGGTGACGATATACTACAG
CGACCTGGTGGCTGGTTTGCTCGGAAGACTGGATAGGCTGGGGTCTCGCTGGTCACCGAGTGTAATGCTGGG
CAAGATCGGAACCACAAGATGGTTCCTGTAGTAACTCGAGGTTAACTTGT |
| 297 | 12 | GGTGTCGTGAGGATCCATGCCTAAGAAAAAACGGAAAGTGGAGGATCCCAAAAAGAAGCGGAAGGTCGGCAG
CGGCTCAATGGCCTATCCAATCGCTGACGACCGGCGAAAGTACTTCCACAGTCTTTTCGAGAACAAGGAGCC
GTACATCGGATACAAGGCTCTGTGTCTGCTGGCCAAGAACGACATCATCAAGAGCGTGTGGACGACCAACTT
TGACGGGTTGACTGTGCGGACCGCATTCCAAAGTAACTTGACCCCCATAGAAATAACCCTCGACAACGCAGA
CAGACTGTTTAGGAACCAAAGCAAGAGAGAGCTGCTGACATATCACTTCATGGCGACTATAAGTATAGCAC
GCTGAAAAATACCGAGAAGGAGTTGGACTCACAGGACGGCACCTTCAGCGAGCATCTGGGTAACTATCACGT
CGACAAGAACCTGATTGTGATAGGTTATTCAGGGCGCGACAAAAGTCTGATGAAATCCCTGAACGATGCATT
CACCAAGAGGGGCACCGGCAGGCTGTATTGGTGCGGCTACGGTGACAAGATCAACACTGAGGTGGAAGAACT
TATACGCAACGTACGAACCGCTGGAAGGGAAGCCTTCTACATATCCACCGATGGTTTTGATAAGACGCTGAT
CGACCTTTCTAAAAGCGCTCTGGAGGACAACAGCATGAGCCTCGAAAGCCTTAATTCCATCCTGAAACTGGC
AAACAACGAGGAGCTCTCAAAGATCGAATTTAGCCAGAGCATCACCAGGACCGACAAATACCTGAAGAGTAA
TCTGCACGCAATTGTGTTCCCCAAGGAGATATTCCAGTTTGAAGTCGAGTTTGGCGACAACAAGCCCTGGTC
ATTCCTTAAAGACAAAACTAACAACACCGACATATGCGCCATCCCCTTCAAGAGGAAGGTTTACGCCCTGGG
CACGCTCACGGTATATCTAGCGTGTTCAAAAAGTGCTCAAAAAGCGAGATTAGGAGGGTACCAATCTCCAA
GTTCGACATCGACAATGTGAGCAGCTTTAGGTCTCTCATGATCCAAACGGTGATCAAGCACTTTCTGTCATA
CGGAATCTTCGACAGCAACCTCAAGGACAAACTGTGGCTTAGAAATTCCGACAATTCCTTCGGGGACAAGAA
AATACACAAGGCGATTTACCTCAGCTTCTACTTCGATAAGAGCAGCAAATTCGGCTACATTAGCTTCAGCCC
CAGCATACACATAACCTCCGATAACGAGATCAGCAAAGAGGTGAAAGAGGATTAGCAAAGAGATCTTGGA
AAAGCTCCGAAACGATAAGTTTGACGAAATACTGGAGTACTGGAACACCATACTGTTCAATTACAAAAATCT
TAAGTTCGAGTACCCCCTTAACAGCGGGACCGGATTCGAGTTCCAAATAAGCCGAAACACTGCGTTTGCCGA
AATCATGGTGCTGGACCCGAACTATCGAGTCTATAAACCAAGCGATTACAACAACAAGCTGACCCAGTTCAG
AGGTGTGCAGTATCTGGAGCCGCAACTGATCTTTCAGAACTCACTGAGTAACTCCCCACACCAAGGACTACCA
CCCCATGAGGGCGTTGACCAATAACAGGCCATACGACAACAACTTGAATGGCATCATCTATTCAAACGAGGT
CAATTTGGCCGTGATTTGCGGGGAAAACTACTCCAAAAACCTCTACGACTTCCTGAACCAGCTTAACCTTAA
ACACCCCACAGACAACATCAACCCCGATTTCCTTATAGAATATCCTGGCTTCGCGAGCGCCTACAACCTCCC
CATCAACATCCCATACTATGAGGACGCGGACAAGTGGATTAACATAGATTTGGAGAAGAGCAACAAGTCCGA
CAGCGAGAACGCCATCATCGTTGCACGCCTCATCACAAGCAAATCGAGCAGATCATAAACATACAGTCTCA
GCACACCATCGTCATCTTCATCCCCAAAGAGTGGCAGGCCTTCGAGAGCTTCCAGGAAAATGGCGAGGACTT
CGACCTCCACGACTACATCAAGGCGTTTAGTGCATCCAAGGGCGTGAGCACCCAGCTCATCAGGGAGGAGAC
ACTGTCAGACAGGTTGAAATGCCAGGTCTACTGGTGGCTGTCTCTGAGTTTTTATGTAAAGTCTCTGCGCAC
GCCATGGGTCTTGAATAATCAGGAGAAAAACACCGCCTACGCCGGCATAGGCTACAGCATTAAGAAGAACAG
CAATGACACCGAGGTGGTGATCGGTTGCAGCCACATTTACGATTCTAATGGCCAGGGCCTGAAGTACAAGTT
GAGTAAAGTAGATAATTACATCCTGGATAAGCAGAGCAATCCCTTCATGAGCTATAATGACGCGTTTCAGTT
CGGCGTGTCAATTAGGGAACTGTTCTACAATAGCCTGGACAGGCTCCCCGAGAGGGTGGTTATCCATAAGCG
GACCAAGTTTACGAACGACGAGATAAAAGGTATTACTGCCAGCCTCAACATGGCGGGATTACCAAGATAGA
TCTCATTGAAATCAACTACGAGACGGAGGCTAGGTTTCTCTCCATGAACGTATTCAACGGCCTTCTGGGCAT
AGACAAATTCCCTATCAGTAGGGGTACCTGCATTATTACGAATAAGTACGAAGCCCTCCTTTGGACCCACGG
CATCGTGCCCTCCGTGAAGAATCCCATTCACAAGTATTACCTGGGCGGCAGGAGCATCCCAGCCCCGATCAA
AATTACTAGGCATTACGGCGAGAGCGATCTGAATACTATTGCCATCGAGATCCTCGGCCTCACCAAAATGAA
TTGGAATAGCTTTGACCTTTACAGCAAGTCCCTGCGACGATTAACTCCTCAAATCAGATAGCCCGGATCGG
TAAGTTGCTGGCGCGCTTTGAGGGCAAGACCTATGATTATAGGCTCTTTATTTAGTAACTCGAGGTTAACTT
GT |
| 298 | 54 | GGTGTCGTGAGGATCCATGCCCAAGAAAAAGAGAAAGGTGGAGGACCCAAAGAAGAAACGGAAAGTTGGCTC
TGGGTCAATGAACCTGACCGTAAACCTCGCCCCCATCAGCGTGCAGGGCGACTGCTCAGTCCTGATTGGCAG
ACAGCGCTACGACGAGCAGAGGCTGGCTGAACTTAGGTCAGACTTTCGGGGCACCCACGTGTTTCGGCGAGA
CGGTCCAGATAGCATGATTGACATCCCCGTGGTCCCCGACGGCGACCTCTGGGCAACCTGAGGGAGACGAT
CGACCTTAGGCGGTACCAGCGGCTGTGGCCCATGCTTCTGCAGGAGTCCCTCATCCAGCTGCTTGGTAAGCG
CCCCATCCAGTCCAGCAAGCCCTTGAAGTTCCTGGGAGCTAGGTCTCCTCTGATCGAGCACCCGGATCTCCC
TGAGTGGTTGAGGCGGGTGAGCGTTACCGAGATCCACACCCGACACATCACCGTGGACGGCAAGCAAATCTA
CGGTATCGTGTGCATGTGAGGGCCAAGTCTTTTATCCTCGCACCTGCAGCGAACTTCTGTGAAATTCGGCAT
GACCATCCTTGGTAGATACGTCCAAATAGAACAGCCCGCGATAGACGAGAGAACCATGCCTAAAAGGAAGCT
CATCGGCAGGGTAAGGTCCATCCAAGGGGATGATCTGCTTCTTGACGACTGTGAGGCCGGCTTCGAAAAAGT
CGCTGCGAATGAGGCATTTCTCGAGCCGCGGAAGGAAAATTTCGAGGACTGCGTGAGGCAGGTGCTGAAGCG
GGACGCCGAGAGGGTGTTGAGAGGTCAGCTCGCGCCAGCCAAAACCTGGCCGCAGGCCCTGGGAAACTGGA
ACACATCGACGGAATCATCAGGTATCTTAGGGAGAAGAAGCCCGCAGCGGTGCCCGGCTGCCATTTCGTGAT |

TABLE 19-continued

Argonaute nucleic acid sequences containing 2 nuclear localization sequences and a cloning sequence

| SEQ ID NO | Argonaute | Sequence |
|---|---|---|
| | | CGATGCCATGCTCAACACAAACGGCCACATTTTTCCACCCGGGGAAACAATGGACAAACCCTTCCTCTTGTT<br>CGACCCTAGCGGTTCACGGAGAGAAGACTGGCCCGAGAAGGGCCTTAAAGATCACGGCCCCTATGATGAGCA<br>GGTGTTTTCCCCCAAGTCCCTGAAGATCGCTGTTGTGTGCCAAAGCCGGTTGGAGGGCAGAGTGGACGAGTT<br>TCTGGCGAAGTTTCTCAATGGGATGCCGAAGGTCTTTCAACCCGGCAAGAGCTTCGCCCGCTACGGCGACGG<br>ATTCGTGAAACGATTCAGACTGAACAAGCCCGAGGTGCACTTCTTTCTTGCAGATGGCAACTCCGACGAGGC<br>ATACGCCGTGGCCAGCCGCGAGGCACTCGATAAAGCGAGGGATAGCGGGTTCGAGTGGGACCTGGCGATTGT<br>GCAAATTGAGGAGGAGTTCAAGTCACTGGCCGACGGCTCCAATCCCTACTACACCACTAAGAGCATCTTCTT<br>GCGGAGGGACGTTCCGGTGCAGAGCGTCAGGCTGGAGACCATGAGCCTGTCAGATAATGACCTGGTGTTCCC<br>CATGAACCACCTGAGCCTCGCTACCTACGCCAAGCTGGGGGGCACGCCCTGGCTCCTGGCTAGCTCACAAAC<br>CGTGGCGCACGAACTGGTGATCGGACTGGGTAGCAGCACCAGCTCCGAATCAAGGCTGGGCAGCCAGATGAG<br>ACATGTGGGAATCACCACCGTGTTCAGCAGTGACGGCGAGCTACCTGCTTTCTGATAGAACCGCCGCAGTGCC<br>CTTCGAGCAGTACCCACAAGAGTTGAGGAAAACGTTGCGAAAAACAATCGAGGCCGTCAGGGCCGAGGACAA<br>TTGGCGGAGTAGCGACAAGGTGAGGTTGGTATTCCATTCATTCAAGCCGTTCAAGGACAGCGAGGTAGAAGC<br>CATAGAGGCGCTGACCACCGACCTGGGCCTGGGCGACGTGAAGGCCGCCTTTCTGCACATTGCGCCCGACCA<br>CCCGTTCCTTATCTTCGACCACGACCAAATGGGCATCGCCGCCACGAGGGGGCAAAAAAGGCGTGTTGGGCCC<br>TGCTAGGCAGTTGCACATCCGGCTTAGCGACGCTGAGAGCCTTGTGGTCTTCGCAGGGGCCAGCGAGCTTAA<br>ACAGGTGACGGATGGTATGCCGCGACCCGCGCTGCTCAAGCTGCACCCCAAAAGCACCTTCAAAGATATGAC<br>CTACCTGGCAAGGCAGGCCTTTGCCTTTAGTGCCCATAGCTGGCGGATGCTGTCCCCCGAACCTTTCCCAAT<br>TACTATCCGCTACAGCGACCTGATCGCCGACCGCCTGGCGGGACTCGCGTCGTTGAAGGGCTGGGACCCCGA<br>TGCCGTGACGTTCGGCGCTATCGGTCACAAGCCTTGGTTCTTGTAGTAACTCGAGGTTAACTTGT |
| 299 | 23 | GGTGTCGTGAGGATCCATGCCAAAGAAGAAACGAAAGTGGAAGATCCCAAGAAAAAAGGAAAGTTGGTAG<br>CGGCAGTATGATAATGAGCCTGGAGAGCAATATCTTCACTTTTAGCAACCTCGGGACACTTACCACGCAGTA<br>CCGACTGTATGAGATCAGAGGCCTGCAGAAAAGGCACCAAGAGTACTACCAGAACAGGCAAATCCTGATCCA<br>CCGACTCTCCTACCTTCTGAAAAATGCCGTAACTATCATAGAGCGCGACGAGAAACTGTACCTTGTTGTAGC<br>TGCCGATGCCCCGGAACCACCCAATAGTTATCCCATCGTTAGGGGCGTCATCTACTTCAAGCCCACCGGCCA<br>GATTCTGACCCTGGACTACAGCCTCCGAACACCCCAGAACGAAGAGATCTGCCGAGGGTTCCTCCATTTCAT<br>GGTACAAAGTGCCCTGTTTCAAAACGCGAATTTGTGGCAACCCAGCGCCGGAAAGGCTTTCTTCGAGAAAAA<br>GCCCTCATTCGAGTTCGGATCAATTCTGTTGTTTCAGGGATTTAGCGTTAGGCCCATATTCACCAAGGACAA<br>GATCGGCCTGTGTAGACATCCACCATAAATTCGTCAGCAAAGAACCCCTCCCTAGCTACCTGAACTTCAA<br>CGAGTTCCAAAAATACAGAGGCGTGTCATGCATCTACCATTTCGGCCACCAGTGGTACGAGATCCAACTCTC<br>TGAACTCTCCGAGCTTAACGCGACGGAGGCAATGGTACCCATCGAGAATAAGTTCGTGACCCTTATTAACTA<br>CATCACCCAGCAAGCCAGGAAGCCCATCCCGAAGAGCTGGCAAACGTGTCACAGGACGCAGCCGTCGTGCA<br>CTACTTTAACAATCAGAACCAGGACAGGATGGCGGTGACGAGTCTGTGCTATCAGGTTTACGACAACTCTTA<br>TCCAGAAATCCGAAAGTACCACCAGCACACCATTCTGAAGCCACACATCCGCCGCAGCGCGATCCACGGAAT<br>AGTGCAGAATATCTCGCGGAGCTCAGGTTCGGCGACATAACCCTGAAGGTATCAACTATCCCCGAGCTGGT<br>GCCCCAGGAGATGTTCAACCTGCCCGACTATTGCTTCGGCAACGATTACAAACTGAGCGTGAAAGGAAGCGA<br>GGGCACAGCCCAGATTAGCCTCGACCAGGTCGGGAAGCAGCGCCTTGAGCTGCTGAGTAAGGCTGAAGCTGG<br>TATCTACGTGCAGGAAAAGTTCGACCGCCAATACATTCTCCTGCCCCAAACCGTGGGGGACAGCTTCGGGAG<br>CCGGTTCATCGACGACCTCAAGAAGACCGTGGACAAGCTGTACCCCGCTGGAGGAGGGTACGACCCGAAGAT<br>CATTTACTACCCCGACCGAGGTCTCCGGACCTACATCGAGCAGGGTAGGGCTATACTGAAAACAGTTGAAGA<br>GAACGAGCTGCAGCCCGGCTACGGTATCGTAATGCTTCATGACAGTCCGGATCGACTGCTCAGACAACACGA<br>CAAACTCGCAGCTCTGGTCATTAGGGAGCTGAAGGACTACGATCTGTACGTGGCCGTCATCCACAGCAAGAC<br>CGGGAGGGAGTGCTATGAGTTGAGATATAACAACCAGGGCGAGCCCTTCTATGCAGTAATACATGAAAAACG<br>GGGGAAGCTCTACGGCTACATGAGAGGGGTGGCGCTCAATAAGGTGCTTCTCACCAACGAGAGGTGGCCCTT<br>TGTGCTTTCTACCCCCCTGAATGCGGACGTGGTGATCGGAATCGACGTCAAGCACCACACCGCCGGTTACAT<br>AGTCGTCAACAAGAACGGGAGCAGGATCTGGACTCTGCCCACGATCACGAGCAAGCAGAAGGAGAGGCTGCC<br>CAGTATCCAAATAAAGGCGAGCTTGATCGAGATCATCACTAAGGAGGCCGAGCAAACAGTAGATCAGCTGCA<br>CAACATAGTGATACATAGGGACGGACGAATACACGAAAGCGAGATCGAGGGCGCCAAGCAGGCGATGGCCGA<br>GTTGATTAGCAGGTGTACGCTGCCTGTGAACGCCACACTCACGATCCTGGAAGTGCGAAGAGCAGCCCCGT<br>TAGCTTTAGGCTGTTTGATGTCTCCAATACCAATTCTAAGGACCCGTTTGTGCAAAACCCACAAGTCGGGTG<br>CTACTACATTGCCAACAGCACTGACGCCTACCTGTGTAGCACGGGGAGGGCGTTTCTCAAGTTTGGCACCGT<br>GAACCCCCTGCACATAAGGTATGTGGAAGGTACGCTCCCCCTTAAACTGTGTTTGGAAGACGTGTACTATCT<br>GACAGCCCTGCCTTGGACGAAACCCGACGGGTGCATCAGGTACCCCATTACCGTAAAGATCAACGACAGGAG<br>GCTTGGGGAGGACGCCAGTGAGTACGACGAAGACGCCCTGCGCTTCGAGCTGTTCGAGTCTCTCGAGTCCGA<br>GGATGACTTTGACGAGATGACCGACAGCGACTTTAATCAGGAGGAGACAATGGTGTAGTAACTCGAGGTTAA<br>CTTGT |
| 300 | 16 | GGTGTCGTGAGGATCCATGCCCAAAAAGAAGCGGAAAGTCGAAGACCCCAAGAAGAAGAGAAAGGTGGGCTC<br>CGGCAGCGTGGGCGACAAGACCTTCAGCTTCAAGGTGTATAGGAAACTGAAACAGCAGAACGACACCAAGGA<br>AGACGAGATATACCTTTACAATTTGCCCCAAGGCGAGACCCTGAATGATTACAAGCCATATTGGATCAGTTT<br>TACCCCCGAAGGACGGATTCGAAGAATACATCGCTAATTCTTACTTGAGCATCGGCCTGTCAAAAAAGTACCT<br>GTTCAATAGATTCGTGGAGACGCTCAGCAACTCAAAACTGCACTTCACCTACAAGGTCAAAAGGAAATTCAC<br>CGACTGGTACGTCGATTTCGTAATCGCGCAGTACAGCCAGGGAGACAGGATCATCTACATGAGCCCCTACTT<br>CCTGGAAGAGCAAAACACCTACGGCTTCATCATCGACTTCAAGTTCAGCAAGAAGGATGGTATCCCCTTCGA<br>TTAGGAGGTGCAAAAGCTGTCCCTTTCACTGGATAGCAACGGCCGCCAGCAACAAAACTATTACTCTGACAA<br>ATTTAGGCTGGTGAACAATTTCATTAAGGAGATTTACACCTCCATAAAGAACATCGGGACCAGTAATAATCC<br>TATCACCATTTCCAGCAACCTCATAGAGACCACCGTGTTCCACCTGAACAAGAAAGAGTACATCTTTAGCAA<br>TAACAAGTAAGCTCTAGCCAGTTCCAGGGCGTGAGGAATTTCGGTGTCTATAAGAATATCCCCCAGGACGT<br>GATCTTCGCGTTCATATTCGAGGATAGGTTCAGGAGCTTCGCCAACGAGCTGTATCTGAGCCTTACCGGAAA<br>ATTGAACCCCGGGACCTTTCCCGGACTGGAGCAGATGTTCGGCATCAGCATCAACACCAAAACGTGAGACA<br>GATCAAGTTGGAGAACTACTCTCTGGATTCAATGCTTAGGGTGGTGAATGACGTGAAGAGCTTGCAGGAGAA<br>CAATCCCGATAAGAAGATCGTGGGAATCTACGTGAAGACTGCACCATCGACAGCGAGGACATCCCTGCGTC<br>CAACAACTACTACTTTCTGAAGTATCACTTTATCAAAAATGACCTGCCACTGCAGGTTGTGAATTATCGGAA |

TABLE 19-continued

Argonaute nucleic acid sequences containing 2 nuclear localization sequences and a cloning sequence

| SEQ ID NO | Argonaute | Sequence |
|---|---|---|
| | | GCTGGGCGAAAGGAATTCTCTGAAATGGAGTACCTCCAACCTGGCCCTGGCCATGTTCGCAAAGATGGGCGG CATCCCCTGGGTCGTAAAACCGTCTAATAAGAACTGCTTGATTCTTGGCATCGGATCTAGTCATAAGATAAA CCGGGAGACCGGCGATATACTTAAATACTTTGCATACACCATATGTCTCGACTCCAGTGGCCTGTACAAGGC CCTTGAGGTGCTGGCCGACGAGGAGAGCGAGGTGAGCTACCTTGAGAAGCTTACTGCCAATCTGGTCGCCAT ACTGAAGGAACAAAAGACCAATTACGGCACCTGTGTGCTGCACCTGCCCTTCAAGATTAAGAAAAAGAGGT AGCCGCCATTAGTGATGCCATAAAACAAATCAACGACATCGAGCTGGTGGTGGTAAAGATCAATGTGGATAA CAAGTATTTCGGATACTCCTTCCACAACACATTGGTGCCCTACGAGAGCAGCTTCGTGAAGCTTTCTAAGGA TGAGTATCTGGTGTGGTTCGAGGGCCTGCTGTACGGCAAAGAGATCGTAGATAAGAGGTTGAGCAACCCCGT GCACATCCAATTCTTGAACATCACCAACAGGAAGAACTTCGATGAGCAGGCGTTTCTGCAGGACATTCTGAA TTTGAGCGGAGCCAACTGGAGGGGCTTCAACGCCAAAAGCATCCCTATCTCAATTTACTATTCTCAAATCAT CGCGAGGTACACCGAGGCCTTCGAAAACATCGACGGTTACAAGGAGGGTACTATCTCTAACGACAAACCCTG GTTCCTGTAGTAACTCGAGGTTAACTTGT |
| 301 | 53 | GGTGTCGTGAGGATCCATGCCGAAGAAAAAAGGAAGGTGGAGGACCCAAAGAAGAAACGGAAAGTTGGCAG CGGCTCCATGAGCGTGGCGATCGTGAGCCCCCAAATGTACAAGAGTCTGAGCGAGGTGTTTCCTCTGACCGC CTCCCAACTGAACTTTATGTGCTTTAGGCTGACTCCCGAAATCGAAAAGAAGGATGGTAATAGGCTCAGCTA CCATTTCAGTCTGAAGCTGCCGGAAACTGTTGTGATCTGGCACCAGCCCTACTTCTGGGTGTTGGCGAGTAG TAACAGGCAAATCCCCAATAAGGACGAGTTGCAAGAAACTCTGATAAGGATCCAAAACGAGGTGGATGACTT CAAAGAACGACTCTTCGGTTTCCAGAGCGTTCGCCACCCCCAACTCACCCCCTTTATCATCAGCCTCTTCGC CGTGCAGGTCCTCAAAAAAACAAAGTTCGACTACCCCATTGCATTCAGCAACAACGGTGTAATCGTCAGGAG GGAGCCCGACTTTTGGACGGAGAGCATAGAGCTTCAAGACAGCCTGCATCCTGCCCTCACGCTGACCGTAAG TTCATCAATAGTGTTCCGCGACAACCTCGCGGAGTTCTATGAAAAACATCATCAAAGGGAGAAGCCCGAGCA GTTTCTGATCGGCCTGAAGGTGCAGGAAATAGAGAGGGGCAACAATCGCGATCATCGTGGGACTCGTCGGCAC CATCGGCGAGCACCGGGACCAGCTGCTTGAAAAAGCAACCGGGAGCACTAGCAAGCAGGCGCTGCGAGAGGC ACCGGACAACCAGCCGGTGGTTGCGATACAGTTCGGCAAGGATACGAAGCAGTTCTACTACGCAATGGCCGC GTTGCGGCCGTGCGTAACCTCAGAGACGGCAAACCAGTTCGAGGTAGAGTACGGTAAGCTCCTGAAAGCTAC AAAGATAAGCCACCAGGAGCGAACCAACCTGCTGGCCTCATACAAGAAGACGGCCCAGGAGTCATTGGCCGC TTATGGCATCCGCCTGGAGCTGAGTGTGAATAGCAGGGATTACCCCAGCTTCTTCTGGCAACCCCCCGTGAA GATCGAAGATACCCAAACTTCTGTTTGGCAACGGCATAACCGGCAAGCGGACTGAGGTGCTCAAGGGGCTTTC TATAGGGGGCGTGTACCGACGCCACGGGAAATTCCAGGACAAGTCAAAAGTGATCCAGATCGCGGCTCTTAA GCTTTGCGACGTGACCGTTAGCTTGTTCCTGAAGCAACTTACTCAAAGGCTGGCAAAATACGGCTTCCGAAG CGAGATAATCACCAAGAAGCCTCTGTCAATCAAGAACCTTGCCACCGCCGAAGCCAGGGCTGCTGTTGAGAA AGCGGTCAATGAGCTCGTGGAAATACCCCACGACATCGTGCTTGCCTTCCTGCCTGAGTCCGACAGGCACAC CGACGACACGGATGAGGGTTCCTTCTATCACCAGATCTACTCCCTTCTCCTCAGAAGACAAATAGCCTCACA AATTATCTACGAGGACACCCTGTCCAACTCTGGGAACTACCAGTACATCCTGAACCAGGTCATTCCGGGGAT CTTGGCGAAACTCGGGAATCTGCCCTTCATTTTGGCGGAAAGCCTCGATATAGCGGACCACTTCATCGGACT TGACATCAGCAGAATCTCTAAGAAAACGCAGGTCGGGACACGAAACGCGTGCGCCAGCGTGCGACTTTACGG ACGCCAGGGTGAATTTATCCGCTACCGGCTTGAAGACGACCTGATCGACGGCGAGGCGATTCCACCCAAGCT GCTGGAAAGGTTGCTGCCTGCGACCGAGCTTGCGAATAAAACCATACTGATCTACAGGGACGGGAGCTTCGT GGGCAAAGAGGCCGACTATCTTGTGGGAGCGAGCCAAGGCGATAGACGCGAAGTTTATCCTCGTCGAGTGTAA GAAATCCGGCGTGCCGCGCTTGTATAACTTGGAGCAAAAGACCGTGATCGCGCCGAGTCAGGGACTGGCTCT TCGACTGAGCAGTAGGGAAGCAATACTCGTGACCACCAAGGTGCCCGATAAAGTGGGCCTGGCTAGACCCAT CCGGCTCACAATCCACGAAAAGGGCCATCAAGTAAGCATCGAATCCGTGCTGGACACTACACTCAAGCTTAC TCTTCTTCACCATGGCGCGCTGAAAGAACCGCGACTGCCCATGCCCCTGTATGGGAGCGACAGGATGGCATA CCTCCGGCTGCAGGGGATACGGCCTAGCGTTATGGAGGGCGACCGCCAATTCTGGCTGTAGTAACTCGAGGT TAACTTGT |
| 302 | 88 | GGTGTCGTGAGGATCCATGCCCAAAAGAAGAGGAAGGTAGAGGACCCTAAAAAAAAAGAAAGGTAGGTTC CGGATCCATGGAAGAAAATCTGTATCTTGAATACGACGCTTTCTTGAGGAGTGTGAAGCGCAACGTGGACGT CCCTCATAGTTTCTTGCTTGGAGCCGGAGCTTCCATCTCCTCCGGAATTCAGTCTGCATACGACTGTATATG GGAGTGGAAGAGAGATATCTACATCACGAAGAATATAAACGCCGCCGAGTACTATAAAAATCATAAAAACGA AACGGTTCGCAAATCAATACAGAAGTGGCTGGACAACCATGGCAACTACCCCATCCTGGATGCAGCAGAAGA GTACACATTTTACGCCGAGAAAGCTCATCCAATCGCTGACGATAGGAGAAAGTACTTCTTTAGTCTGATTGA GAATAAAGAACCATATATCGGTTACAAATTGCTGTGCTTTCTCGCTTCACAGGGGATTGTAAAGAGTGTATG GACGACCAATTTTGACGGGCTGATTGTACGAGCTGCTCACCAGAATAATTTGACGCCTATAGAAATCACCTT GGATAACGCGGAGCGCATATTCGAAATCAGAGTACTAAGGAGCTTCTCTGCATAGCTCTGCACGGTGACTA CAAATATAGCACCTTGAAGAATACTGATACCGAACTGGATAACCAACACGAAATTTTTCAGGAGCACCTCGG AAATTATCACGTAGATAAAATTTTATAGTAGCTGGTTATAGTGGACGCGACAAGTCTCTGATGGATGCACT CAAGGCCGCTTATTCCAAGAAAGGATCTGGTAGGTTGTATTGGTGTGGCTATGGTGAGAAGATAAATTCTGA AGTGAAAGATCTTCTTAAGTATATTAGAGCGAGTGGGAGGGAAGCATACTATATAGCTACGGATGGGTTTGA CAAAATGCTCATACACTTGTCAAAGGCAATATTTGAGGATAGCCAAGGACTGAGTGAAAAAATCCAGAAAAT ACTCGAAAGCACGAATCAAACCGAGACCTTCAACACAGAATTCAAGTTGGAGTTTAAAAAAACCGACAAATA TATCAAATCAAATCTGCACCCTATTGTTTTTCCTAAGGAAGTATTTCAGTTGCAGATCGAGTATGGCAATGA AAAACCGTGGTCCTTCCTGAAAACACTGACAACTCAAACGAACATTAGCGCCGTACCGTTCAAAGGCAATGT CTACGCACTTGGTACGCTTAGCGAGATCAATTCCATCTTCAAGCCGTATCTTAAAAGCGAGGTCAAGAGGGA AGCGATCAGCCGATTCGACATCGAAAACGTCACCGCATTCAAAAACCTCATGTTGACAGCCATATCCAAATA TTTTTGCTACACGAAAGAAGTGAACTCTAACTACAAAGATAAGATTTGGTTGAAAAACATCCGTCCAAGGT GGGGGATATCACTGTTCACAAAGCAATTTTCATATCCCTGTACTTTGACAAGAATTCCCATTTTGGTTATAT GGCGTTCGTCCTACCGTTTATTTGGATTCCGACTGCGAAATTGACGGAGAGTCAAAAGCAATCCATCAGTAA GAATTTGCTTGAGAAGTTGTATAATAACAAATATAACGAAGAGCTCGAACTGTGGAATGGTATCTTGTTTAA TCATAAGAAAGTGAATTTGAATATCCTCCCTTGTCTGGTACGGGGTTCGAATTTCAGATATCAAGCAACAC TGCCTTCGGGGAGATAGACGTGATTGATAACAAGTACCGCTCTTACGTCCCCCAGAATTATGATAATAAGCA GACTCAGTTCCGGGGAATCCAGTTTTTGGAGCCGCAGCTGATATTTAAGAACATCGCAACGAACTCTGACTT CAAGGATTATCATCCCATGCGAGGACTGATTAACAACCGACCATATGATGTAAATCTCAACGGGATTATCCA |

TABLE 19-continued

Argonaute nucleic acid sequences containing 2 nuclear localization sequences and a cloning sequence

| SEQ ID NO | Argonaute | Sequence |
|---|---|---|
| | | CTCCAATGAAATTAACCTCTCAATCATCTGTAGCCAAAAGTATGGAGAAAGGTTGTTCGCATTCTTGACACA<br>GCTCAATAGTAAGCACAGTACAGAAAATATCAACACTGACTACCTGATAGATTACCCCGGCTTCCTGTCCGC<br>CTTTAATCTGCCCATCAACATCCCAGCCACCAACGATGACGCTAGCTGGATGGACATCAACTTCGTAGCAGA<br>TAACTCTAAAGAAACACACGAGAACGCTATACGACTCGCGAGGGCAATTACCAATAAGATCGAGAAGATTTC<br>TGCTATACAAAGCGCCAGCACTATAGTAATCTTTATACCTTTCGAGTGGCAGCCCTTCGAAACATATATTAA<br>CGAAATAGAGACGTTTGATTTGCACGACTACATTAAAGCGTTTAGCGCCAGCAAGGGGATATCAACGCAACT<br>TATTCGGGAGGACACCCTTGACGATAAGCTCAAGTGCCAAATATACTGGTGGTTGTCTCTTTCTTTTTACGT<br>GAAGAGCCTCAGGACCCCATGGATATTGAACAACCAGGAGCGGAAAACAGCTTATGCCGGAATTGGGTACTC<br>CATAAGCAAGGTAAAGAACAAGTCAGAGATCGTGATCGGATGTTCACATATATATGATTCAAATGGCCAAGG<br>CCTTAAGTATCGCCTCTCAAAAATTGATAACTACTTTCTCGATAAGCAAAATAATCCGTACCTGTCTTATAA<br>GGACGCTTTTCAATTTGGGGTTAGTATCAGAGAGCTCTTCTATCAGTCACTCGATTCTCTGCCAGAAAGGGT<br>CGTCATCCATAAAAGGACAAAATTCACCGAGGATGAGATCAATGGGATAAAGGCTTCACTCAACCAGGCTGG<br>TATTAAGAAGATTGATCTTATAGAGATCAACTACGATATAGATGCAAAATTCGTTGCCATGAACGTGTTCGA<br>TAACAAATTGCAGGTCGATAAATTCCCGATATCCAGAGGAACATGCATTGTGACAAATAAACGGACGGCGTT<br>GTTGTGGACGCATGGTATAGTACCTTCAGTTAAGCAGCCCAATTATAAGTTCTACCTGGGCGGGCGCTCTAT<br>CCCTGCGCCCATAAAGATTACCAAGCATCACGGAGAAAGCAACATTGATGTGATAGCTAGTGAGATCCTCGG<br>ACTCACAAAAATGAATTGGAATAGCCTGGATCTCTACAGTAAACTTCCCTCTACGATAGATTCTTCTAACCA<br>GATTGCTAAGATAGGAAAACTTCTGTCTCGCTTTGAGGGCCGCTCATATGACTACAGGCTGTTTATTTAGTA<br>ACTCGAGGTTAACTTGT |
| 303 | 17 | GGTGTCGTGAGGATCCATGCCGAAGAAAAAGCGAAAGTGGAAGACCCCAAAAAGAAGCGGAAGGTGGGCAG<br>CGGCAGCATGGACAATTTGGCTCTCTCTGCGCTTCAGCTGGACAGTAGATTGGATCACTGTATGGTATATCA<br>ATACAGGATCGTGTACCATAAGTTCGACGAAACAGAAGGCGGGTGAAAAACTGGCAAGAAGGCCGCCTACGA<br>ACTGTGGAAGGTAAACAACTTCGGACTGCTCACCAACCTGGGTGCCAGTAGCATCCTGTCCCTTAAGAGCCT<br>GAGTCAGCTGTCTATCGATTCACCGCTGTTGCAGGCAAGTTTGAAAGCTGACGGCCAGTTGGAGCTGGATTG<br>CGGTAACGAACAGCATCAGGAGGCGCTGCAGAGACTCGTGAACCAGGACATAAACAAAGCGGCTTGGAACCT<br>CAAACAAGCGAGCGAGGGGAAGCTTGATTGCCGAAAATCACCAGGCGGGCACGCCGAAATCTTCGAGCCAAG<br>TCACAGTAGTCGGATCAAGGCCCACAGTACCTATTTGGATGCCTTCTGCACCGTAAGGCTGATTCCCGAAGT<br>GCTGTCAGACGGGACAGTGCTGATAGGGTTGCATCTTAAGCACAGCCTGACCGCGAAGGCGGACATCTCTCT<br>TCAGTGGGTCATTGATCATAGGCCCGATTGGCTGATATCCATAGAGAAGGTGCGCCACAGGTATTACGAGCC<br>CGGCAAAGCACCCCTCGTTGCGGAGTTCGTGAAAGTCGATGATTCCATCAACGGATCATCCCTTCTCCCACA<br>CTTGGGCAAATCCCTTGTCGCTTACCACCAGGAGAAAGGGCTGCTTTCAGCCGGACAGCTCGCAGAGGCAGC<br>CACCAGCTCACTCATCAAAGTGCGCTACGGACAGAAGGAGGCAGACCACGTTGCTAGCTTGGTGGAACCCAT<br>GTTTGATTTCGATACTCTGTCAAAGATTGACAGCCCCTTCCTGAATAGGCTCGCCAAAGACCTGAAGTGGAG<br>CTTGGACGATAGAATAAAGACAAGCGCGGAGATGGTCAAGAGGCTCTACCTGCCCGGGTTTAATCGAAAGTT<br>GGTACAAGTTGACTACCAGAATCTGAGCAGGAAGAGGTTCAACCACAACCTTATGCTTCCAGTTCGCGGATGG<br>GGCAAGGAGCGGCCATGAACAAGACGTCCTGAAATACAAGGCTTTCGCCGACATGACCAGGGCTAGGGTAAT<br>CCCACTCGTGGTAGGAGAGAGGAACAACACCGAAAGCAATAGACAATTGCTCCGGAACGCCTATAACGCACT<br>GAGGCAACTTACCAAGGCCGAATTGCCCCCCTTCACGTCATTTCCCCCCAGCATCGGAAACGCCGACGAGTT<br>GGACGCACGGCTGCACAAGAAATGTCCCGACAACGCCATCCTGCTTATCGGGCTCACAGAGAAGAGTGACAA<br>AGCCGCGATCAGGGACACGGCGTTCAACTACGGCCTGGCCACCCAGTTCATGAGGCTCGATCACAAGCCCAA<br>GGTTTACGACAGCTTCTACTTCAATAACGTCGCAGCGGGCCTGTTCTCCAAGGGAGGAGGGCAACTGTGCGC<br>CGTGAACGACATGCCCGGTGAGACTGAACTGTTTATCGGTCTGGACATGGGCGGCGTGAATGTAAGGGCGCC<br>AGGTTTCGCATTCCTGTTTCTCAACTCTGGCGCGCAACTGGGCTGGCAGCTGGCTGACAAGCAGCAGGGCGA<br>GAAAATGCAGGACGACGCTCTCAGCAATCTGCTGGAGAAGTCTCTCAAAACCTACCTGAGGAGCACCGACGG<br>GCTTTTGCCAAGGAGGATAACTCTGCACAGGGACGGCAGGTTTTACGAGAGCATCAATGTGATAGAACAGTT<br>TGAGCAGAAGCACGGGGTCAAGCTCGATGTTCTGGAAGTCTTGAAAAGCGGAGCCCCGGTGCTGTACCGGAG<br>AGAACGCAGTGCGGACGGTAAGAAAGTTTTCAGCAACCCAGGGGTTGGCGATGCCGTCTTCCTTAGCGACAG<br>GGAGGTCATTCTTAGCACTTACAGCGGCGAGGAACTTGGGAAGTCATGGGGTAACAAGGTGAGTGTGAGGCC<br>ACTTCGACTCCGAAAGAGATACGGCGAGACCGCATTGAGCGTGTTGGCCCATCAGGTGTTGGTCCTGTCTAG<br>GATCCATGGGGCCAGCCTCTACCGACACCCCCGACTTCCGGTGACCACCCACCACGCGGACAGGTTCGCAAC<br>CTTGCGGCAAGATGCGTGCATAGACGCACTTAGTAAGATGGATAGACTGTGTCCGGTGTATCTGTAGTAACT<br>CGAGGTTAACTTGT |
| 304 | 37 | GGTGTCGTGAGGATCCATGCCCAAGAAAAAGCGAAAGTGGAAGATCCGAAAAAGAAGAGGAAAGTGGGCAG<br>CGGGTCTATGAATAACGTGATGCAGGAGTTTCCCGTCGCAAGCTTCCCCACATTCTTGTCCGAGATCAGTCT<br>GCTTGACATCACACCGAAGAACTTTATCTGCTTTAGGCTCACCCCCGAAATCGAGCGCAAGACCGGTAACAG<br>TTTTAGCTGGCGCTTCAGCCAAAAATTCCCTGACGCCGTCGTGATTTGGCATAACAAGTTTTTCTGGGTACT<br>CGCTAAGCCCAATAGACCAATGCCCAGCCAGGAGCAGTGGAGAGAAAAGTTGCTGGAAATCTGCGAGGAACT<br>TAAGAAGGACATAGGCGACAGAACCTACGCCATTCAGTGGGTTAGCCAGCCCCAAATAACCCCTGAGATCCT<br>GTCTCAACTCGCCGTCAGAGTGTTGAAGATCAACTGTAGGTTTGACTCTCCCAGCGTAATTTCTGTCAATCA<br>AGTTGAAGTGAAGAGGGAGATCGACTTTTGGGCCGAAACAATTGAGATTCAGACCCAGATCCAACCCGCTTT<br>GACCATCACCGTGCACAGTTCATTCTTCTATCAACGACACCTGGAAGAGTTCTACAATAATCACCCTTACAG<br>GCAGAACCCCGAGCAACTGCTCATCGGCCTCAAGGTGAGGGACATTGAAAGGAATAGCTTCGCGACGATTAC<br>TGACATTGTGGGCACCATAGCGGACCACCGCCAGAAGCTGCTCGAGGATGCCACTGGAGCTATTAGTAAGCA<br>AGCCCTTATAGAGGCCCCAGAAGAGCAGCCCGTGGTCGCCGTACAGTTCGGTAAGAACCAACAACCCTTCTA<br>CTACGCAATGGCCGCGTTGCGGCCTTGTATCACCGCCGAGACCGCTAGGAAGTTTGACGTGGACTACGGCAA<br>ACTGCTGTCCGCCACCAAGATACCCTACTTGGAGCGGAAGGAGCTGTTGGCTCTCTACAAAAGGAGGCGGG<br>TCAATCTCTGCGACTTATGGTTTCCAATTGAAAATCAGCATCAACAGCAGGAGGCATCCGGAGTCTTTTTT<br>CAGCCCAAGCGTGAAATGAGCGAGACCAAACTCGTATTCGGGAAAAACCAAATAGGGGTGCAGGGGCAAAT<br>TCTTAGCGGATTGAGCAAGGGTGGGGTGTACAGAAGGCATGAGGACTTCAGCGACCTCTCAAGACCTATACG<br>CATCGCTGCGCTTAAATTGTGCGACTACCCTGCGAATTCATTTCTGCAAGAGACCCGGCAACGCCTCAAACG<br>GTACGGTTTTGAGACTCTGCTGCCCGTCGAGAATAAGAAAACCCTGCTGGTAGACGATCTGAGCGGGGTCGA<br>AGCACGCGCGAAAGCCGAGGAAGCCGTTGACGAACTGATGGTGAACCACCCCGACATCGTGCTCACTTTCTT |

TABLE 19-continued

Argonaute nucleic acid sequences containing 2 nuclear localization sequences and a cloning sequence

| SEQ ID NO | Argonaute | Sequence |
|---|---|---|
| | | GCCGACCAGTGATAGGCACAGCGACAACACGGAAGGCGGCTCATTGTATAGTTGGATTTATTCCCGACTGCT<br>GCGGCGAGGGATTGCTTCACAGGTTATCTACGAGGACACGCTTAAGAGTGTGGAGGCGAAATATCTCCTTAA<br>CCAGGTGATCCCCGGAATATTGGCAAAACTCGGCAACCTGCCGTTCGTACTTGCGGGAGCCCCTGGGAATCGC<br>TGACTACTTCATAGGCCTGGACATCTCCAGGTCAGCAAAGAAACGGGGGTCTGGAACCATGAATGCCTGTGC<br>CAGCGTTAGGCTGTATGGTAGGAAGGGCGAATTTATCAGGTACAGGCTTGAGGACGCACTGATCGAAGGGGA<br>GGAAATACCTCAGCGCATTCTGGAGAGTTTTCTGCCAGCCGCTCAACTGAAGGGCAAGGTAGTGCTCATTTA<br>CAGGGACGGCCGATTCTGTGGTGACGAGGTCCAGCACTTGAAAGAGAGAGCAAAGGCTATAGGAAGCGAGTT<br>CATCCTGGTTGAATGCTACAAGAGTGGGATTCCACGACTGTATAACTGGGAAGAAGAAGTCATAAAGGCACC<br>AACTCTGGGACTGGCCCTTAGGTTGAGTGCGAGAGAAGTGATTCTGGTGACAACCGAGCTGAACAGCGCAAA<br>AATCGGTCTTCCTTTGCCTCTGCGACTCAGAATTCACGAAGCCGGTCACCAAGTATCTCTCGAGTCTTTGGT<br>AGAAGCCACACTGAAGTTGACCCTCCTCCACCACGGCAGCCTGACGAACCGCGGCTGCCTATACCACTGTT<br>TGGTTCCGATCGAATGGCCTACCGGAGACTCCAGGGCATATATCCCGGATTGTTGGAGGGGGATCGGCAGTT<br>CTGGCTTTAGTAACTCGAGGTTAACTTGT |
| 305 | 38 | GGTGTCGTGAGGATCCATGCCTAAGAAAAAGAGAAAGGTAGAAGACCCAAAGAAGAAGCGGAAGGTGGGCTC<br>CGGTTCAATGAACCTGACTCTGTTCAACGAGATCCTCCCCATCAACATCAGCCAACTGCCCAACCAGTACTT<br>CTACAAGCTGTGCACTGCCGGCGACGTGGACCTGGATTCTCTGGGCAGGAGCATCAAGTACCGGATCCAGAA<br>ATACTTCAGAGGAATCTGGGTGTGGAGTACCAACGACCAACTCCTCATTTCAGACAAGCTCATCGAGTACCC<br>CGAACTGCAAAAGTTCACCCAGTATCTGTGGACCGACCAGTCTAACCTCACATTCAACCAGCTCGAGGGGAT<br>AGAAATCGAGAACATTAGGTGTTGCACCCCCCAAGGCATCGCTGATTTCTGTAGCCAAGGTCTCATCAAAAA<br>GTACGACCAGCAGATCAAGAAGATACTCGAACAGTCCAAGACAGCACGGAGAGACTATCATATCAAACTGAT<br>CCACAAGTTCGGCTCCTGGGTGGTGAACAATCAGCCCTGCATAAGCCTGAGCCTGAAACAGGAGATCGATTT<br>TAACGGAACTCTCCAGGACTACCTGACCAAGTTCCCCAACTCTAACATCATCGGCCTGCATGTGCTCGACAT<br>CACTAAGCCTTTCAACACCGCACAGGAGGTCATCAAGATTCTCGGTATCTTGGGTGAGGGAAATCGGCGGCA<br>GCGCCTCCTGACTTGGGTCAAGGAGCCAACCATGAAAAAACTCGTGGAAGAGGCCCCAGATAGTGAGCTCGT<br>AGTTGAGATCGGGAACAAGAAAAAATCCTATCATTACATCATTTCTGCCCTGCGCATCAGAGTCCTCAACCA<br>AGATTACCTGAGGCTGGGGATTAGCGAGAAGCTGCAAATAGTCAGTGAAGAGAGGTTGAAGTACATCGAGCC<br>ACTTTTCCGCATACTGCAATCAGAGGGCTTCCTGGACAAGGTGTATACTAGCCAGCGCAACCCCGAGCTGTT<br>TAGGTCATGCAGCGAGGAATGGGGTTACAATCCCTGCTGAAGTTCAAGAATAACGCCACTGTTGCGGCGGA<br>ATCCGTGCAGTCCACGGTCCAGGTGGTGCAGAAACACGGCGAATTCAGGAAAGCCGACAAAAGCGAAATTAG<br>GATCGCCATACTCAACACACTGAAGAGTGAAAACAGCACCAAATTGATTGAGATTTTCCGAAACAACTTTAA<br>GCGAAGCTTTAACCAGAATTTGGAGGGAATCGGTAATCAGCTTAAGTATAAACTCAAGTTGGTGGGCCAGCC<br>CATTGCACTGGATCTCAGTAAGAACTCCCTCAGCCTGCTGGACAGCAAAATAGGAGAATTGTCTAAAAAGAA<br>GCCGGACATTGTGATCTGTGTGATCCCTAACTTCCTTAGCAAGGGCGAAGACGGGCGGACACTTTACGACGA<br>TTTGAAGCAGACGTTCCTCAAATACAATCTCCAATCACAAATGTTGCAGGAGAAGACTCTCACGACGTCATT<br>TGCCACAAAGAACATCGTGTTGGGCGTGCTGGCGAAATTGGAAGCGTTCCCTATATTCTGCAAGAACCGCT<br>GACGTACACGGACTTTGTCGTAGGTTTGGACGTGAGCAGGCGACGCAAAAAAAAACCTGCAAGGAACCAACAG<br>CGTAGCCGCCATGACCCGAATCTACAGCAATCAAGGCGAACTGGTCCACTATAGCATCCGAGACGCAACCAT<br>CGACGGCGAGATCATTCCCAAGAGGATGCTCTACGACCTCTTTCCACTTCACGAATATCAGGGCAAACGCGT<br>GGTGATTCACCGGGACGGAAACTTCCCCGAGGAAGAGCGCCAGGCACTCGAGGGAAATTGCCGAAAAGATTGA<br>CGCGAAGTTCTACTTCGTAAGCATTATCAAATCTGGCAATCCCAGGATCTACGGTAGGACCAAAAACGAAGA<br>GGGCATCGGCAGTTATCGCAAGGCACCTAAGGGTAGCATTTTCCTTCCTCAGCGAGACGGAGGCCTTGCTTAT<br>CAGCAGCGACTTTCCGGACCGCTTCAGGGCCACGCCACAGCCTCTCAGAATTAAGACGTTTGGCAACTTTCC<br>CCTTCAAAGCGCCGTCCATAGCGTTCTGTCACTCACCTACCTGCACTACGGTTCCGAGCGCCCACCGAGGCT<br>GCCGGTGTCTACCTACTACGCAGATAGCATTAGCACTATGGTATCCAAGGGCATTAAGCCCAAGGACGTTGA<br>CGGCAATATACCCTTTTGGCTGTAGTAACTCGAGGTTAACTTGT |
| 306 | 25 | GGTGTCGTGAGGATCCATGCCGAAAAAGAAGCGGAAGGTTGAAGATCCAAAGAAGAAGAGGAAGGTGGGGTC<br>TGGGTCAATGCTCCTTAATCATCTCCCAATCGAGTTCTCCAGCGCACAGTTCGCTGGACACGAAATTGCTTA<br>TGTCGACGGCGAGCAGTTGAGGTCCATACGACAGAGACTCACGCGCACGCACTTCGTGTTGAGGGATGGGGA<br>CAATGTTCTGCTCTTCCCGTACGAACATGGAACCGCGACCGAGGGAACCAGGCGAACATTCGACACGGGCGT<br>TAATTTCAGCGTAGCCAACGCCCTGGCGCGCAACGGCATGCTTCTGCGATTCTTCCAGCACTCTAGAAGTAT<br>TTCCGGCGTCCGACCGGTGAAATTTGTGAAAGACAACCAGAACCTGCTCACGGGTGACGTAGGCCGGTTGTT<br>TGCTATATGTCCGGAGTACAGTTTCGACATCCGACCCCTGGCACCTCAAGACGGCAGCCTTGTGAACGGGGT<br>ACTGGTAAACTTCTCAGCCCGATTTTTGGTGAAGCCCTCCCTCGACGAATTGATTGCGCAGGGGCTCGACCC<br>ACGGGGGCCTGTATGTTGTTAAAGAGGCAGAAAGAGAATCACCCTACATCCTGCCGATGTTTAATCGGAGATT<br>GGTAGGGCGGATCCAGGACGTGGTCGGAGGTATCGCCAAGCTGGTGGACGAGCGCGAACAGGACCTCCCTGT<br>ACATGAACTTCATGTCGAGGCCAACCTGGTCAACTTCGAGAAAGTAGGCAGAGCACTGCTTGGCCGGGATTA<br>CGAGCGAGTGAGTCGACAAGTGCTTCCCACCCTCCATAAGGTGAGCGGCGCAGAGAAACAGCTCGATCGCTT<br>GGTCCAGCTGCTGACGAGCTTCAAAGACCTCCAGGGTGACATCCCGTGTTGCGACGGCCTGACCGTTAGACT<br>GGCAGGCATACTTACAGATGTGCCCTTCGGCAGTGAGGTGGGCCAATTCCGCAAATTGTCCGCGCCACAGTG<br>CAGCCTCCGCCCAGGGGGAACTATTACGGTGCCGTGGCCCGTGGACGGCAAACTCAATGCCAACGGCCCCTT<br>TGATGCAGACGCCTTCAGCAGGAAGGAACCAACAATCGGCGTTCGTTTCCGGAGCAGCACAAGGGTAGTGT<br>AGAAGAGCTGGCCGCTAAACTCAGAGACGGCGCACCGAGCGATGGAAAGTACCCAAGTCCATTTCCCCAAGG<br>AATGCCCCGGAAGTATAGACTTAGGAAGATGACATATGAGCTGACGCCCACGAAAGTTTCAGGGGACAGGGC<br>CGCAGCCTACAAGAATGCCGCGCTTGCAGCCGCCCAACAAGAGCTTGATCGCTCTGGTGGTCATATCTGA<br>ATCAGATAAGGCGTTGCTTGGAGCCGCCAGCCCCTACTACACTGCGAAAGCCACATTGATGAGCAAGGCGT<br>GCCGGTGCAGGCTATTACCATTGAGACTATCAACAGGCTCAACCCCTACACCTTGAATAATCTGGCACTTTC<br>CCTTTACGCAAAACTCGGCGGGATACCTTGGACGCTGTCAGTTCAACAGCGACTGGTCCACAGAGATAATTGT<br>AGGGATAGGGTCTGCGAGAGTGGGCTTCGACCGCCTCTCAGAGCGGGAGAGGCTTGTCGGCATCACGACCGT<br>GTTCTCCGGGGACGGATCATACCTTCTTGGCAATGCAACGACGGAAGCCAGCAGTACCGAATATAGGTCTCG<br>CCTTCTGGAGAGCCTTAGGGCGACTTTGGCAGAGTTGCGAAGACGATTTGGCTGGCAGCGGGGAGATAAATT<br>GAGGATTATCTTCCACCAAAGCTATAAGCGGTACAAGGAGACCGAAGCAACCGCCGTTAGCGACCTCATCGC<br>CGAACTTGATGAATTCGATGTGGAATTCGCGTTTGTGCAGATCAGTAGCGATCATGACTGGAAGTTGTTCGA |

TABLE 19-continued

Argonaute nucleic acid sequences containing 2 nuclear localization sequences
and a cloning sequence

| SEQ ID NO | Argonaute | Sequence |
|---|---|---|
| | | TGAGAGTGCCACAGGCGTTACGTATCAGTCCCGGCAAAAGGGAGCGAAGGTGCCGGAACGCGGAGTCATAGT<br>CCCTCTCGGACCTCGCGCTGCGCTGATCACGTTGGTGGGTCCGCATCAACTGAAAACCGACCTGCAAGGGTG<br>CCCCTCCCCCATACTGGTGTCTATCCACCCGAGCTCAACTTTCAAGGATTTGAGTTACGTGTCAAAGCAGGT<br>GTTCGACTTGACCTTTATGAGTTGGCGAAGCTTTAACCCAAGCACGCAGCCCGTTTCCGTGAGTTATCCCAA<br>CATGGTGGTGGATCTGCTCGGTAACCTGCGGCAAATCCCCAACTTCAATCCCGACATTCTGACGACAAAACT<br>GAGGGAGTCTAGGTGGTTTCTGTAGTAACTCGAGGTTAACTTGT |
| 307 | 20 | GGTGTCGTGAGGATCCATGCCAAAGAAAAAAGGAAAGTCGAGGACCCCAAAAAGAAGCGAAAGTGGGCAG<br>CGGCTCCTTGGACAATTACATACTGACCGAGTACAAGGCCGGCATCCACGCCAGCGAGATCAAGATACACAT<br>CTACCGGATGCCCGTCAAGGATCTTGAGAAAATCGACTATGAGTACGGGAAGTACACACGCGACCTCAGACA<br>AAAAAACAGGAAGACGATATCCTTTTACCGCTCTCTGATCGGCAGCTTTGAGAAGCTCACCATCGTGCCCAA<br>GGGATACGAGAAGTACGAGTATAGATCAATTAAACTCGACCAGAGTGAGGAGTCACTCCAGGAGAGGAAACT<br>GCTGGAGAGGCTGATCTTCGACGGCCTTAGGGACAGCAATAGGAACCACTTTATGAGCACCGAGCAGAGCAT<br>CATCGAGAAAGAGCCCATCAAGTCCCTGAGCAAGTGCAAAATCCACCGGGGTATCTACATAGACATCACCGT<br>GAAAGAGAAAGGCGACATCTTCATCGGTTTCGAGCTGAAGCACTCCATCCAGAGCACCCACCACGATTATCA<br>GGCTCTGAAGGAGAAGAAACTGAACAAGGGCGATAAGGTGTTTGACTTTCTGAACAGCGCCCACTACGAGTT<br>CGAGGGGATTAGCGACAAAACCATCAGCGACCCCCTTCCCGAACTGGGCAACAAGAGCATTATCCAGCACTA<br>CAAAACGAAACCCAGCATCTACTGCCACCTCGTGAAAAAACCGAACATGCCCGCCATCCTGGTACGCAGCAA<br>GAGCGGCAAGGTGTATCCTTACCCCCACAGCTGCTTAAGAAGGGAGTGCCTGATGAAGGATGTGCCGGCTAA<br>GGAGCACAGCTCTATCAAGCTGAACCCCAACGATAAGATCAACTACAGCATTGAGATCATGAAGAGAATCAT<br>AGATGCGTTCGAGAACAGGTATTTCCCCATCGGCTTTGAAAAGAACAACCTGAACATCGCCAAGCTCGGATA<br>CAGGAGGAGGCTGGTCCCGGATCCCCTGCTGAGGATTGGCAACGGAGCCACCTGCAACCACAGAGACCTCAA<br>GGGTGCCTTCCTTAGGCACAAGATTTATGCACAGCGTGAGCTCCCCTATCTACTACCAGCTTCTGCTTGACCA<br>ACCCTTCGAAAGGGAGTGGCAGAAAAAGATGAGCGAAGCGTTCATTACGAAGATGGAAAACCGGAGCAGGCA<br>GTGGGGCATAAAGCTTCAGTGTACCGGGAACCAGATCCTCCCTACCTCTAACCCGTACGCGCTGAGACTGCA<br>TCTTAAGGACATCAACCTGGATACCGACATCATTAGCGTGGTCCTGTTGGACGAGACCAAACAAGAAGGCGA<br>GGAGGTTTACTCTACCATCAAAAAAGAGCTGGGTGGCACCAGGGGCGCACATACCCAGGTAATCCTGATCGA<br>TAGCCTGAAGAACGAATACACTATCCCCCAGATACTGTTGGGAATCTACACCAAGGCTGGATTGCAGCCCTG<br>GGTCTTGCACCAGCCGTTGCACGCCGACTGCTACGTTGGCTACGACGTGAGCCATGAAAATGGCAGGCACAC<br>CACTGGCATAGTGCAAGTGTTCGGCAAAGACGGGTCACAGATCTTCAGTCAGCCCATTAGCAGCGCGGAGGC<br>CGGAGAGAAGGTGTCAAAGGAGACCATTCAGACTATGGTGATACACGTTCTTTACTATTACCAGAAGAAAGT<br>TGGCAAGATGCCACAGCACATTGTCTTCCACAGGGACGGCCGAGGATACGTAGAGGGAGATAGACTGGATTAA<br>AGACATATTGAGTAATAGGGACCTCACCAACGGCCAAAGCATCGCTTTCGATTACATCTCAGTGATCAAAGA<br>GTGTGGTCGGCGCATGGCTTACTTTGACGACATAAAGAAGAAGTATGTGAACGTGCCCGGGATTGCCTACCT<br>GGACGACAACGCCCAAAAGGCCTATCTTTGCAGCACCAATCCATACGAAAAAGTAGGGATGAGCAAACCTAT<br>TAAGATTGTGAAGAAGATTGGCGAGATGACCCTGGAGCAGATCGTAGAAGACATCTATCACCTGAGTTTTAT<br>GAATATCGACACCGATAGGAAGGTGAGGCTGCCCGTGACTACCAATTACGCCGATAAGTCTTCAACGTTTTT<br>CTCTCGCGGCTATCTGTCATCACAAAAGAAAGGAATTGGCTTCGTATAGTAACTCGAGGTTAACTTGT |
| 308 | 69 | GGTGTCGTGAGGATCCATGCCCAAGAAGAAGAGAAAGGTCGAGGACCCGAAAAGAAGCGAAAGGTAGGTAG<br>TGGTTCCATGGTCGGCGGCTATAAAGTCAGCAATTTGACAGTGGAAGCGTTCGAAGGTATCGGGAGTGTCAA<br>CCCCGATGCTGTTTTACCAATACAAAGTCACCGGAAAGGGAAAGTACGATAATGTGTATAAGATTATCAAAAG<br>CGCACGGTACAAGATGCATTCTAAGACCGATTCAAGCCCGTGTTCATCAAGGACGACAAACTGTACACCCT<br>CGAGAAGCTCCCGGATATAGAAGACCTGGATTTCGCAAACATTAACTTCGTGAAAAGCGAGGTTCTCAGCAT<br>AGAGGATAATATGTCAATTTATGGCGAGGTGGTGAAATACTATATCAATCTCAAGCTGAAAAAAGTGAAGGT<br>GTTGGGAAAATACCCCAAGTACAGGATCAATTACAGCAAAGAGATTCTCAGTAATACGCTGCTGACACGAGA<br>GCTCAAAGACGAGTTTAAGAAATCAAATAAGGGGTTTTAACCTGAAACGGAAGTTTAGAATTTCCCCCGTGGT<br>GAATAAGATGGCAAAGTGATACTCTATTTGTCCTGCAGTGCTGATTTCAGCACCAACAAGAACATTTACGA<br>AATGTTGAAAGAGGGCTTGGAGGTTGAGGGGCTGGCCGTTAAGAGCGAGTGGAGCAATATCAGTGGCAACCT<br>GGTGATCGAGAGCGTACTGGAAACCAAGATATCCGAGCCCACTAGCCTGGGCCAATCCCTGATAGACTACTA<br>TAAGAATAACAACCAGGGCTATAGGGTGAAGGATTTCACCGATGAGGATCTGAATGCCAACATTGTCAACGT<br>GAGAGGGAAATAAGAAGATCTATATGTATATTCCGCACGCGTTGAAGCCGATAATCACCCGGGAGTACCTGGC<br>CAAGAACGATCCAGAGTTTTCTAAGGAGATCGAGCAGTTATCAAGATGAATATGAACTACCGATATGAAAC<br>CCTCAAGTCATTTGTGAATGACATCGGGGTCATTGAAGAGCTGAACAACCTGAGCTTCAAAAACAAATACTA<br>CGAAGATGTGAAACTGCTGGGTTACTCCAGCGGCAAAATAGACGAACCCGTCCTGATGGGGGCAAAAGGGAT<br>CATAAAGAACAAAATGCAGATTTTTTCCAATGGATTCTACAAACTCCCCGAAGGCAAGGTACGATTTGGCGT<br>TCTGTACCCAAAAGAATTTGATGCGTGTCAAGGAAAGCTATCCGCGCCATTTATGACTTCAGTAAGGAGGG<br>CAAATACCACGGCGAAAGCAACAAGTATATCGCGGAACACCTGATAAACGTGGAGTTCAATCCAAAGGAGTG<br>CATATTTGAGGGATACGAACTGGGCGATATCACCGAATACAAGAAGGCGGCTCTGAAACTTAATAACTACAA<br>CAATGTCGACTTCGTAATCGCAATAGTCCCGAACATGTCCGACGAAGAGATAGAGAACAGCTACAATCCGTT<br>CAAGAAAATATGGGCCGAACTGAATCTGCCCAGCCAGCGATGATTAGCGTCAAGACGGCCGAAATCTTTGCCAA<br>TAGCAGGGATAACACGGCGCTTTACTACCTGCATAACATCGTCCTCGGTATCCTGGGTAAGATAGGAGGGAT<br>TCCCTGGGTGGTTAAAGACATGAAGGGCGACGTGGATTGCTTCGTTGGACTCGATGTCGGCACCAGGGAGAA<br>GGGCATACATTACCCCGCCTGCAGCGTTGTGTTTGACAAGTACGGCAAGCTTATTAACTATTACAAGCCTAA<br>CATCCCGCAGAACGGAGAGAAGATTAACACAGAAATACTTCAGGAAATTTTCGACAAGGTGCTCATAAGCTA<br>TGAGGAGGAGAATGGAGCCTACCCGAAGAATATCGTGATCCACAGGGACGGCTTTAGCCGAGAGGACCTTGA<br>CTGGTATGAGAACTACTTCGGTAAGAAAAACATAAAGTTTAACATCATCGAAGTCAAAAAGTCAACTCCGTT<br>GAAAATCGCCAGTATAAACGAGGGAAATATCACGAATCCTGAAAAGGGTTCCTACATCCTGCGCGGCAACAA<br>AGCCTACATGGTGACCACAGATATTAAGGAAACCTGGGAAGCCCAAAGCCCCTGAAGATAGAAAAGAGCTA<br>CGGCGACATAGACATGCTCACAGCTCTCAGCCAAATATACGCACTCACGCAAATCCATGTGGGGCGACCAA<br>AAGCCTGCGCCTCCCAATCACCACCGGCTACGCCGACAAGATTTGCAAGGCGATCGAGTTCATCCCCCAAGG<br>GCGCGTGGACAACCGCCTTTTCTTTCTGTAGTAACTCGAGGTTAACTTGT |

TABLE 19-continued

Argonaute nucleic acid sequences containing 2 nuclear localization sequences and a cloning sequence

| SEQ ID NO | Argonaute | Sequence |
|---|---|---|
| 309 | 76 (Helicase) | GGTGTCGTGAGGATCCATGCCAAAAAAGAAGAGAAAGGTAGAGGATCCCAAGAAGAAACGCAAGGTGGGGTC
CGGCAGTATGGACCGCGAGATCATTGAAAACTTCAACCCCAGCGACCCCAGGACCGAGGGCGAGAAGTATCT
GATGGATAACTTTTCAACCTCCCCCAGGTTTAATGGCTGGACAATATTTGAGCAGCCCCACATCAACTCAAT
GAAGCCCGACTTCATCTTGCTGCACCCCCACAAGGGCATCATAATCATAGAAGTGAAGGACTGGAACCTCAG
CAGCGAGACATATGAGAACGGCGGTTACATCTGGGGGGAAAACGGCGAGAGGATTAAGAAAAACCCCATCAA
TCAAGTAGAAAACTACAAAAACTCTATACTCAAGATGGAACTTACAAACAGCATCGAATTTAGTGAAGTGTT
CGGCGACAAATACTTCGCGTGCATAGAAACGGTGGTATACTTTCACAAAGCCAACAAAATTCAAGCCGAGAA
CTTCTGCAGGAGGAACAATAACTACACCAAGATCTGGACCAAGGACGAGTTCGACTACATATGCAATATCAA
TTACAAACTGAAGGGCAGTTGTCACACCTATGCCCTGAGCTACGAAAAAAGCACCCTTGAAGACAACAGAGG
TATGCTGAGTAAACTGGTGGAGGAGCTCAAGTGCAATCTCCAGTACAGTGACTACAACTATGAACGACGCCA
ACCGATTAAGTTGACCTATGAGCAAGAGAAGTTGGCGAGGCTGCAAAAGAATTCAATCAGGAGGTGGAGCGG
CGTGGCAGGCGCTGGCAAGTCCCTGAGTCTGGCGCAAAAAGCCGTGAACGCCCTGAAGGAGGACCATAGCGT
TCTGATCCTGACCTACAACATAACCCTGAGGCACTACCTGCGCGATCTGTGCTCTCAACAGTTCGGACCCGG
CTCCTACAAAGGCGAGCGCAAGAAGCTGAGGAGCGACCTGACCATCTGTCACTTTCATGACTTTTTGAGAAT
CATCATGGCCGAGTACGAGATCGAGGTCGAACATGACGAAGACGACAACTTCACCCAGCACTGGATAAACAA
GATCGACAGTTGCATAAAGGTGAACGGCATCAAGAGCCACCTCAAGTACGACTATATCCTGATCGACGAGGG
CCAAGACTTTGAAGGCAATGGATTAGGTTCCTGAAGCAGTTCTTCACCGAGGTGGGTGAGATCTTTATCGT
GTACGACAAGGCCCAGGATCTCTACGAGCATGGCGTGTGGATCGAAGACAGCAACCAAATCAAAAACATCGG
CTTTAAGGGCAAGCCCGGGAACCTGAAATCAGTATGAGGATGCCTGAGAAGATGGTGTACCTGGTGCAGGA
CATCAGAAATGAGTTCAAGATAGATGAGGAGGAGATCACCCCAAACGTGAACAGCCAGCAGAGCTTCATCGA
GATAACCAAGTGGATTAACTGTATGCCCCTGACGCTCACTGAAAAGCTCGACCAGATTGAAATACAGGTGGA
CTTTCTGCGCCGAAACAACAACAGCCTGGAGGATATCACGATCATTACGACCAACGAGGAGCCGGAGTGGA
GATAGTGAATAGGTTCAAAAGCAGGGGTATCAAGACCAGCCACGTCTACGATATGGAGAAGCGGGGGAACCA
GGCCAGGCGAAGGATGGAAAAATGGAAATTCCAGGGCGGCACCGGCAGACTGAAGATTTGTAGCTATCACAG
CTATAAGGGCTGGGAGACTCCGAACATCATCCTTGTGCTGGACGAGCCGAGCACAAAGTATGAAGACGGCAT
AATTAGTAAGGGGGAGTATAACGAGAAGAACATTTTCGACGCTATCTTCATTAGCATGTCCAGGGTGAAAAG
GAAAGCCCAAACCGGTGAGTTTAGCTTTACGTGCCTGAATTATCTTAGCGAATACAATAAGATTGAGGGCCT
CTTCCACTAGTAACTCGAGGTTAACTTGT |
| 310 | 75 (Helicase) | GGTGTCGTGAGGATCCATGCCTAAGAAAAAGCGGAAAGTTGAAGACCCCAAAAAGAAACGAAAGTCGGAAG
CGGCTCACTGGGGCTGAATAATGAGTCCAAAGAGTTCTTTAAGGGCATTAGCCGCATTTGGAGAAATTACAA
GGACTACACCTACCTTGACGGGATTAAGCTGAGCCAGGCGCAGATCGATATCATCGAGAAGGAGGAAGACCA
ATTGCTTATAGAGGGCTACGCCGGCACCGGTAAGTCCCTGACCCTTATATACAAGTTCATTAACGTGCTGGT
TCGGGAAGATGGGAAGAGGGTGCTGTATGTGACTTTTAACGATACGCTGATCGAGGATACGAAAAAACGCCT
TAGTTATTGCAACGAGTACAACGAGAATAAAGAGAGGCACCACCTGATAGAGATTTGCACATTCCATGAGATCGC
CAGTAATATCCTGAAAAAAAAGAAGATCATAGACAGGGGTATTGAGAAACTGACGGCTAAAAAGATAGAAGA
TTACAAAGGTGCCGCTCTCCGCAGAATTGCGGGAATCCTGGCTAGGTACATCGAGGGGGGAAAGTATTATAG
CGAGTTGCCTAAAGAGGAACGCCTCTACAAGCACATGACGAGAACTTTATCAGGGAGGAGGTGGCCTGGAT
CAAGGCCATGGGCTTTATAGAAAAGGAGAAGTATTTCGAAGAAGATCGCATTGGGAGGTCCAAGAGTATCAG
GCTGACGCGCTCACAACGCAAAACTATATTCAAGATATTTGAAAAGTACTGCGAAGAGCAAGAAAACAAATT
CTTCAAAAGCCTCGACTTGGAGGATTACGCCCTGAAGCTCATCCAGAACATAGATAATTTCGATGACCTTAA
GTTCGACTACATTTTTGTGGACGAGGTACAGGATCTCGATCCCATGCAAATTAAGGCGCTGTGTCTGCTGAC
CAATACGAGCATCGTGCTGTCAGGCGACGCGATCAGCGGATTTACAAGAAATCTCCCGTGAAGTACGAGGA
GCTCGGCCTCAGAATCAAAGAGAAGGGGAAACGGAAAATTCTGAACAAGAACTATCGGTCCACGGGTGAGAT
TGTCAAGCTCGCGAACTCAATCAAGTTCTTCGACGAGTCCATCAATAAGTATAATGAAAAGCAGTTCGTAAA
ATCCGGTGATCGCCCGATCATCCGGAAGGTGAACGACAAAAAGGGTGCGGTGAAGTTCCTGATCGGCGAGAT
CAAAAAAATCCACGAAGAGGACCCCTACAAAACAATCGCCATCATCCACCGAGAGAAAAACGAGCTTATCGG
CTTCCAAAAGTCCGAGTTCCGAAAGTACCTGGAAGGCCAGCTGTACATGGAAAATTCAGTGACATCAAGTC
CTTTGAGTCAAAGTTTGATTTGAGGGAAAGAACCAGGTGTTCTACACCAACGGCTACGATGTAAAGGGGCT
GGAATTTGATGTGGTGTTCATCATAAACTTCAACACGGCCAACTACCCACTGAGTAAAGAGCTGAAGAAAAT
CAAGGACGAAAACGACGGCAAGGAAATGACGCTCATTAAAGACGATGTGCTCGAGTTTATCAATCGCGAGAA
GAGGCTGCTGTACGTAGCTATGACCAGGGCCAAAGAAAAGCTGTATCTCGTGGCCGACTGCAAAACAGCAA
CATCAGCAGCTTCATCTACGACTTTAACACCAAGTACTATGAGGCACAAAATTTCAAGAAGAAAGAGATAGA
GGAGAACTACAACCGGTACAAGATTAACATGGAGCGCGAATACGGCATCATCATTGAGGACGACGACTCCAA
CAACGTTAAGAACAATGACACGAAACAAGAGAACAAGTTTAATACCGAATCTAAGGAAAAGGGCAAAGATGA
CATCGACAAGATAAAGGTGTTTTTCATCAACAAGGGAATCGAGGTGGTGGACAACCGAGATAAGAGCGGGTG
CTTGTGGATCGTCGCCGGGAAGGAAGCGATCCCTCTTATGAAGAAGTTCGGTGTCCTGGGCTATAACTTCAT
ATTCATCGCAAACGGCGGTCGGGCATCTAAGAACCGGCCAGCCTGGTACCTCAAGAATAGCTAGTAACTCGA
GGTTAACTTGT |
| 311 | 14 | GGTGTCGTGAGGATCCATGCCTAAGAAGAAGCGGAAGGTGGAAGACCCGAAGAAAAACGAAAGGTGGGCTC
CGGAAGCATGAACAACACCATAAACAAATAGACTTCGGCGCGTTTCTGAGATCATTCAAGCAGAACCTGGA
CGGTAGCTTTTCTTTCCTTCTGGGAGCAGGCGCGAGTGTGAGCAGCGGCGTACAGTCTGCAAGCGACTGCAT
TTGGGACTGGAAAAAAGACATTTTTCTGGCCCAAAACCTTCAATTTGAGGAGTTTCTGGACATCCATAGTGA
CTTCTGTAAAGATAAAATCCAAAAGTGGTTGGATGAGCAGGGCGTGTTTCCAAGCGAGACTCAGAGGAAGA
GTACGTGTTTTATGCCGAGAAAGCGTACCCAATGGAACAGGACAGGACCAAGTATTTCGAGAACCTTTGCGC
GGACAAAAC0000TACATAGGGTATAAACTGCTGATGCTGCTGAACAAATACGGAGTTCTGAAATCCGTGTG
GACAACGAATTTTGACGGTCTGATAGAACGCGCAGCGACCGCGATCTGACGCCCATCGCCGTTACCCT
CGACAACCCCGAAAGGATTAGCCGAAACGAGAGTAAATCTGAGCTGCTCTACGTGGCACTCCACGGTGACTA
CAAGTATAGCAAGCTGAAGAACACAGCCCAAGAGCTGGACGCGCAAGAAATTCTCTTCACCGAACGCCTGAA
GTCTTACTTCATCGATAAGAATTTGGTGGTGATCGGTTACAGCGGTCGAGACAAAAGTTTGATGCACACCTT
GTGCGAGGCTTTTATGACGAAGGGGTGCGGTCGGCTTTACTGGTGCGGCTACGGTAACAAGATTACCTCTGA
AGTGCAGAACTTCCTCAACAGAATAAACGATTCAGGTAGGGAAGCCGTGTACGTGGACACCGATGGGTTCGA |

TABLE 19-continued

Argonaute nucleic acid sequences containing 2 nuclear localization sequences and a cloning sequence

| SEQ ID NO | Argonaute | Sequence |
|---|---|---|
| | | TGCCACCCTCGTGTCTATTATGAAGTTTTGCTACGAGGATCAATTCGACAAGAAAATCGAAATCGGCAAGTA<br>TCTCAAGGGCCTGTCAAGGGTGAAGCATATTATCCCTTTCAGCGTTGAGAATACCACGTTCACCGGCTGCGC<br>CAAGACCAACCTGTACCCCTTGATCATCCCCCAAGACATATTCCAGTTCGAGATAGAGAGCCCCGAAGGTAG<br>CAGCAAATGGACCTTCATTAAAGAGAAGATTAAGGGCAAGGACATTATCGCTGCCCCTTACGAGAAAATAGT<br>CTACGCATACGGGCTGCCAAACTCAATCTACAACGTATTCAGTAAGGAGCTGATCGGCGAGATCAAGAGGGT<br>TCCCATCAGCCTGAGTAACATCAAAGACAACAGCACCCTCAAGAATATCATCCTGAAGGTGCTGATATGTTC<br>TCTGAGCAGTAACGCGGGACTCAGGGCGAGTATGAGCAAGAAGATCATCTGGAATGAGAAAGAGAGGTTCCA<br>GAGCAACGTTTTTAAGGCAATAAAGATCGACATCGTTTTCATCAATAGCGAAAAGTACGCCCTCATCTCAAT<br>CACCCCTACCCTCTATTTCAACAAGGAGGGCAACTACACGACGCTGCAGAAGCAGGAAATTACGCGGAGCTA<br>CATTGACAAGCTGTACAATAAGATTTATGAGGAAACCCTTTGTTACTGGGAGGCCATCCTGTTTAAGCAGCA<br>GACCAAGATCTGCTTCGACTACCCGCTCAATTCCGGGAACGGCTGTTTCTTCAAGGTTAGCTCTAACAGGGG<br>CGAAGCCCTGTTCAATAATCCGAATAAGCCGTACGTGATTACTAACGACATCATACTTAAACGCAAAATCTA<br>CGAAGGCATCATAATCGACGAGCCCCTCCTGAACTTCTCAGGGTCAACCAGCGCCCACATCATTATGGACTC<br>CAATCCGATGCGCGGTCTCAACAACAATAACCCATATGATCACTTCATTGCAAGCAAGTTTAGGGACGTTTC<br>TATCCACATCGGAGTCGTGTGTCCCTGTACATATAGCGACAGGTTTTTTAGCTTTCTGAACGAGCTGCAAAG<br>TCCGATAAAGAATAACAATCCTAACTCAGACTACATCCAGAACTATAACGGATTCAGCCAGATATACGAAG<br>CATTCTTAATATCCCAGCGATCAACAGCCAATACTGGATCTCATGCCGCAAGAGCAGGATAACAGCATCTC<br>TTTGGCTAGGAACCTGTGTAAATACGCGAACCAGATGGCCACTAACATGCCAGGTATAATAGTTACCTTCTT<br>CATTCCTAACAGCTGGAGCAACCACAAGAGTTTCAAAGAATGTGGCGAGGTATTCGACCTCCACAGTTACAT<br>CAAGGCTTTCGCCGCACAGCACGGTTTTACAACCCAAATCATTGAAGAGCGAACTCTCACAAATCTCTCCAT<br>GAAAAAGGAGATCTATTGGTGGCTGAGCCTGGCGTTCTTTGTAAAGGCTATGCGAGTACCATGGACCCTGGC<br>CAATCTGGACCAGAACACCGCCTTCGCCGGCATCGGCTACTCCCTGAGCAAAAAGCAAAGCGGCAAATTCAA<br>TATCGTTATCGGCTGTAGCCATATCTATAATTCTGAGGGCCAAGGCCTGAGGTACAAGCTCTCAAAGATAGA<br>TAATCCAATCTTGGACCGGAAAAACAACCCGTACCTGACCTATAATGAGGCGTATAAGTTGGGCGTGAACAT<br>ACAGAATCTGTTCATTCAGAGCATGGACAAACTCCCGAAGCGAGTAGTGATCCACAAAAGGATCCCGTTCCT<br>GGAGGACGAGATAAAGGGCATTACCGAGGCGTTGGCCCAGGCCAACATCACGAATGTTGACCTCATCACTAT<br>CACGATCGAAAAGAACATCAGATGCCTGGATCAGTTCTTCTACAATGGTCAAGCCAAGAACAGCAACTTCCC<br>ACTGCATAGGGGCACCTGCATGAAGCTCAGTGATACCGAGTGTCTGTTGTGGACCCACGGCGTGGTGGACTC<br>AATTAAGGCGGGCAGGAACTACTACTCTGGTGGCAAGGGTATCCCCTCCCCCCTCCGCATATCAAAGTTTTA<br>CGGCGCAGGCTCTATGAAGACTATATGCAACGAAATCCTGGGGTTCACAAAGATGAATTGGAATAGCTTTAA<br>CTTCTATACCAAGCTTCCCGCGACCATCGACACCAGCAACACGCTGGCGCAAGTGGGGAACATGCTCGATAA<br>TTACAACGGTATTACATACGATTACAGGTATTTCATCTAGTAACTCGAGGTTAACTTGT |
| 312 | 26 | GGTGTCGTGAGGATCCATGCCTAAGAAGAAGCGAAAAGTTGAAGACCCCAAAAAAAAGCGCAAGGTCGGGAG<br>CGGATCTATGATGGGAGCCAGCGATGAGTATTCCTTTTACGCTGAAAAGGCCTATCCCATAGAAGCGGACAG<br>GCAAAAGTACTTCGAACAGCTGGCGTACAACAAAGCCCCCTACATTGGCTATAAACTCTTGTGTCTGCTGAA<br>TAACGCGGGGCTGATAAAGTCTGTTTGGACCACAAATTTTGATGGCCTGACGGAAAGGGCCGCTCACCAAAT<br>GAACATCACCCCCATCTGCATTACCCTGGACGACCCCGAGGATTTTTAGGAATGAGAACTCTCACGAACT<br>GCTGTATATCGCCCTTCACGGCGATTACAAATATAGCAAGCTCAAAAATACCACCCACGAGCTGGACACCCA<br>AAACAATATCTTCAGAGACGCACTGAAGCGATACTTCGTGGATAAGAATCTTATTGTCATAGGATACAGCGG<br>CCCGAGATAAAAGCCTGATGAACGCACTTAAAGAGGCATTTTCCCAATCCGGCTCCGGGCGACTGTACTGGTG<br>TGGCTTCGGGGACGATATATGCAGCGACGTTAAGGAATTGATAGACATCGCCAGGAGCAATAATCGGATTGC<br>CTACTTCATCCCGACGGACGGCTTCGATAAGACCATGCTCCAACTTAGTCGCGCCTGTTTCGAGGACGACAT<br>TGTGAAGCAGGAGGAAATCAAAAAGCTGATCAAGTCCACGATCAAGAAGGACGAGACGAAGACCAGCTTCCG<br>AATCGAGAGCAGCAGGAACGATAAACTTATTAAGTCTAACCTGCATCCCGTGGCGTTCCCCAAGGACGTGTA<br>CCAGTTCGAGATTAAGACTAACGGCGAGCATCTGTGGAACAACATAGACCAGATCATTGGCGGCAATAAGGA<br>CATAGTTGCCGTACCGTTCAAAGGTAAGGTGTTCGCTGTCTCAAGCATTGCGAAAATCAAGGAGAGGTTCGG<br>GGGCTATATCAAGGGGGAAATATTGAAAGACCCGATTGGCGTCGATGACATCCGCAAAGTATCTGTGTTCCA<br>GCGGCTTTATGATGAAGAGCATCCTGATTGGAATCTCTGAGTTGGCAAATCTGGAAACTGATTGGAAAGTGGCG<br>CCTTTGGAAAAAGAACACCCTGAGGCGAATCGTAAACGGCACGGAGTATTTCATCGCCGACGCTGTAGAGCT<br>GTCCTTTTCTTCGGAAAAGATACCAAGTTTGCCTATCTCAGCATCAAACCGACCATTTACATTTATACACA<br>TAGCGACGAATTCATACCGAAGGATATAAAGCTGCAATTCACAAAGGAGAAGTTCGACCGACTCTATAATGC<br>ACAATACGACCAATCCCTGGAGGAGTGGAATAATCTCATCTTCCACAACAACAGCCTGAGGTTCACCTTTCC<br>CGTACTGACCACCTCCGACATGAGCTTTAGCATCAGCAACAATGTGGCCTTCTCAGGAATTAAGGTTTTGAG<br>TGACAAGTATAAGAGCTACCCCGTTTCTATCGAGCAGAAGCGCATAGTTTTCAAGGGCGTGGAGTTCCTGGA<br>GCCCAGCTGCTGTTTCAAAATAAGAACAGCAACTTCAAGTCACGCGACTTCCATCCCATGAGGGGATTGAT<br>TAACCACTACCCCTTCGACTACCAGAACAATGGGATCACCAACACGTTTAATGTCAAACTCGGCGTGTTGTG<br>CTCCTCTAAGTACTCTACTAGGCTGTACGAGTTTCTCATGAAATTGAATGCCCAACATAAAGCGCCCGAGAA<br>AAACGAGTACATAATTGACTATGCTGGATTCAACCAAATCTACAACATCCCTATTGAGATACCGCTGGTAAA<br>CGACGAGAAGTGGATGGACGTAAAGTTTAATAGCAGCGTGAGTATCAAAGACGACGCTCTCAACCTGGCAAG<br>AATCATATGCACCCAGATCGAGGCGCTTCACGAGTCTTACAAAACTGACATGACCATCGTGATCTTCATTCC<br>CAACGAGTGGCAACCCTACAGACATATCGAGGAGGACACATGGGTTTTTGACCTCCACGACTACATCAAAGC<br>ATATAGCGCTCAGAAAAGAATTTCCACGCAGTTCATAGAGGAAGATACTCTGAACGATTCATTGACGTGCCA<br>GATATATTGGTGGCTCAGCCTTAGTTTTTACGTGAAATCCTTGCGGACGCCGTGGGTTCTGAATGCTAACAA<br>TAATGAGACCGCTTACGCGGGCATCGGCTACAGTATAAAGAATAACAACGGTGAGGCGTCAATTGTCCTCGG<br>GTGTAGCCATATTTACGACAGCCACGGCCAGGGCCTCAAGTACAAATTGAGCAGAGTGCAGGACTGCTACAT<br>CGACAACAAGCGGAACCCCTACCTGAGCTACAATGAGGCCTACAACTTTGGCATAAGTATCAGGGAGCTCTT<br>TCTGCACAGCATGGAGTACCTGCCAAAAAGGGTAGTAGTGCATAAACGCACCGAGTTCAAACCCGACGAAGT<br>GAATGGCATTGTCGACTCACTGCAGATAGCGGGTATCGAGAATATAGACCTTATCTCCATCAACTTCGAGCG<br>GGAAGTTAAATTCATGTCCACTAAATCCAACTACGGGCAGTTGCAAATCGATAACTTTCCCATACGCAGGGG |

TABLE 19-continued

Argonaute nucleic acid sequences containing 2 nuclear localization sequences and a cloning sequence

| SEQ ID NO | Argonaute | Sequence |
|---|---|---|
| | | CACCTGTATCGTGGTGAACGACTATGAAGCCCTTCTCTGGACCCATGGAATTGTGCCGAGCGTTAAGTCCGA<br>TAACAGGACCTTCTATCTGGGCGGACGATCTATTCCTAGCCCTCTTATCATTAAGAAGCATTACGGTAAGAG<br>CGATATCAACGTTATCGCTACAGAGATACTGGGTCTTACCAAGATGAATTGGAACTCTTTTGATCTCTACAC<br>GAAGCTGCCGGCCACCATCGATAGCTCTAATCAAATCGCGCGGATCGGGAACCTGCTGACTAGGTTCGAGGG<br>CAAGACCTATGATTACCGGTTTTTCATTTAGTAACTCGAGGTTAACTTGT |
| 313 | 46 | GGTGTCGTGAGGATCCATGCCCAAAAAGAAACGGAAGGTGGAGGACCCGAAGAAAAAGCGCAAAGTAGGTAG<br>CGGCAGTATGCGATTGGGGCACATAGGCAACGGCTGTTACAGGGAAGGCGTTAAAGCACAATTCCAGACACG<br>AGAGAGGGAGGATGCCGGTTCAAGGGCTGCGGCTGCCCAACCCCCGATTAAGCAATTCGGATACACCGATAG<br>ACTCGGCCTGAACCTCGCCCCCATAAGGTTTTCTAGCGAAGAGTTTGAAGCCGGACGGACGGTGTACCGCGA<br>CGAGGAACAGTACCGAGCTCTTAGGGAAGCCCATCAAGCCACCCATGCCTTTAGGTATGACGCAAGGGACGC<br>GGCTATATACGACATCCCTATGGCAGAAGGGGTGGCGCCTCTGGGTACTCCCGTGAGGATCAAAACTAAGGA<br>CCACCTCGCTCTGCTCGGCAAAGCGGCTAACCACGCGCTGCTCGATTGGCTCGCACCACGCAGAACCATTCT<br>GCGGAGGGCGAGACCTCTTCAGTGCTGGGGCAACAGGAAGGCCTCACTGTTGTCAGCCGCCGTGCGGGATCA<br>AGGACTTGCCGAAACAAAGGGTCTGGATGTTCTGGTAAGGCATTCTTTTGATTTGAGGGCTTTGGGCGCACC<br>TCACCAGGGTGCTGAACCGTACCTTGCCCTGATGTTGGACGTGAGTACGAGCAATGAGCTGGAGATACCTGT<br>GGGCGAGCTTCTGCGCGAGAGATTCGACCCCATCGGTCGATACGTTTGTGCCAGAGCCGACTCTGGCCAAGA<br>TAACGTACTTGCTAGGTTGGAAACACTGGGTAGGGTCGTGGGTGTGGATGGTGGTAAGCTTCAACTGAACGA<br>CTTTACCGGAGAAGAATTCGTGGACGCTGATTCAGTCACGTTGGAGCCTAGATTGGAGAATCTCGATGCGCT<br>CATTCGCCACTTCTATCCCAGGGATGCGCCAAAAATCCTGGAGGGCCTTCGCAAAAGGAGAGTGCCTTTCTC<br>CACCGCGAACGACAAGCTGGCGAAGATACGAGAAGTGCACGGAGGAGTAGCCGGCCACCTTGAAACGATTAG<br>GATCGCTGGCATGGCTATAGAGGTGGGTGCCCTGCTGCAGAGAGGCTCTAACCTGTTTCCCCCACTCATAAG<br>CACGGACCGGCCTGGATTTCTGTTCGGCGCTCAAGGTAGGGAAACTGGCGCGTTCCCCGACGTGGGGGTGAA<br>GCAGCATGGGCCCTACAAGTACATGCAACACGAGCGCAATGAACCTGTGATCGCCATCATCTGCGAGAGCAG<br>GTTTCGGGGTCGGATAGACCAACTCGCCCGAACACTTCGCGATGGTGTCGCGGAAGATGCCTGGCAAGACGC<br>GATGAGGGGCAGAAATAAGGTGCCGGAAAACCCCTTTAGAGGCGGGCTGATCGGTAAATTGAGATTGTCTCG<br>GGTGCAGTTTGAGTTCGAAGAAGTAACCGAGCCCACTCCCGAAGCCTATCGCGAGGCCATCCTTCGGCTGCT<br>TGCGAGACTCCCAGAGACACCCGACCTCGCGTTGGTTCAAATACGAGCGGATTTTAAGCAGCTCCGCAACGA<br>CAGGAACCCATACTTCGCTGCAAAGGCCGCATTCATGACGGTGGGAGTGCCCGTGCAGTCCGTACAAGCCGA<br>GACTGCGGACATGCAGCCCAGTAATTTGGCCTACATGGCCAACAACCTGGCCCTCGCCGCCTACGCAAAATT<br>GGGCGGTAGTCCGTTCGTGATCTCCACACGCATGCCGGCGACGCATGAGCTCGTGGTTGGCTTGGGCTACAC<br>AGAGGTGTCAGAAGGACGCTTTGGACCGAAGTCCCGATTTGTAGGCATCACCACCGTGTTCCAAGGCGATGG<br>CAGGTACTTGGTGTGGGGGCAAACTAGAGAAGTAGAATTTGAAAACTACGCCGACGCTCTCTTGGCGAGTCT<br>GAAGACTACCATCGACACAGTGCGCAAGGACAATAACTGGCAGCCACGCGATCGAGTGAGGTTGGTATTCCA<br>CGTGTATAAGCCCCTTAAACATGTCGAGATCGACGCTATCAAACAGTTGGTGCAGGAGTTGCTGAAGGGCGA<br>ACATGAAGTGGAGTTCGCATTTCTGGACATCTCCCGCTTCCACGATTTTGCCCTTTTCGATCTTCCCAAGA<br>GGGCGTGAATTACTACGCTGACCGCAGACGACTGCTGAAAGGCGTGGGCGTCCCCCTTAGGGGTATCTGCCT<br>CCAACTGGACGAAAGGAGCGTGCTCTTGCAGCTGACAGGCGCTAAGGAGGTGAAGACCAGTGAACAAGGTCT<br>GCCCAGGCCCCTGCGACTGACGTTGCATTCCGAGAGTGATTTTAGGGACCTCACATACTTGGCGCGACAGGT<br>GTACAGCTTTAGCTACCTCTCCTGGCGCAGCTACTTCCCGGCCATAGAGCCGGTGAGCATTACCTACAGCAG<br>ACTTATTGCCAATGCACTTGGCAACCTTAAGAGCATCCCGAACTGGAACAGCACATTCTTGACAGCTGGCCC<br>ACTGAGGTCAAGGATGTGGTTTCTGTAGTAACTCGAGGTTAACTTGT |
| 314 | 49 | GGTGTCGTGAGGATCCATGCCGAAGAAGAAAAGGAAAGTGGAGGACCCCAAGAAAAAGCGCAAGGTTGGCAG<br>CGGGTCCCTGGAGAACCTCACCATAAACATAATCCCCTTCAAGCACCCCAGCATCCAAAAGAATTTGGCTT<br>CTATACCGAGAAGAAGGAGGGCTATTTCCCCATTCATAGGACCGAGTTGCCCAACGAGCTGTGGGACAACCA<br>GAAAGAGGAAGTGGTGAAGCACAAGTTCTACTACACGAACTTTGAAGACACGGAGGATTGCGTTCTGAAGAC<br>CAAGGTGGACCTGTATAGTAGCACTAAGTTTGCCAAGCATCTGTACACGCGATTGGTGTACCAGTATTTCAT<br>TGGGATAGCGGATGCAATCCAGTTCAACTACGTGGGTGACATAGAGGTTTGGCTGCTGGATGCGAAAGCCAG<br>CACCACCAAATACAATAGCTACAACAAGTATACCCTGAAAATAGAGTTTAGCGGTCTGACCAAGAGCCCCGC<br>TCTCCTCCTCAGCTATGACAACACTAGTAAGGTAGCGACTACGAGCATAGACGAAATCAACATTCCCACCGA<br>GTACTTCAAGACCGTCGTGTATAACAAAGAAATCCAGAGGTTCAAGTACCTGACCGAGGACGCGAAACAACA<br>CCTCGATCAAGTGTATCCCCTGCTCAACATACCGTTGAAAAACCATCTTGAGATTCCTCACACCGTTCCCCG<br>CAAGGGCAACAGGTATAAGCCCTACTTTAACCACATTACGACTTTTTACAATAACTATTTGAACACCGACGA<br>ATTCAGGGCCATCCTGCCCCTTGATGAGAATGGATTCTTCAATATCCCAGAGGACAGCATTTTGAAAACTAG<br>CAAAAAATTCTAACAACCTCCGGTTCTATAAGAAAGTCGGAGTAGATCCCAAGGCTGGAATGAAGAAGCCCGG<br>TCCCTACAAGGCCTCCCCCCACGACAACGTGAACCTGTTCTTTATCTATCACAAACCCGACGCACATGAATA<br>CGCCAAAACGTTGCATGACTACTTCATGGAGGGGTACAAAAAGTTCTTTCCCCCCCTCAAGAACGTTATCCG<br>GCAGCCGCTGTTCCTGGACAAAGGCACCTCACTTGCATTTGAGAGCTTCGACAGCTGCATCGCCGAGCTGAA<br>AACCCATCTGTTCGACCTCAAAAAAAAGCCCAATACCCGGTACGTGGCCATCTACGTGAGCCCCATCCATAA<br>GGAGGACGAAGACAATAAACACCTGTACTACCAGGTCAAAGAAGAGCTGCTTAAACATGACATCACCAGCCA<br>GGTGATTTACAAAGAGTCCATCAAAGATAAATACTTCGGCGCTTTCCTCGAGAATATCGCACCCAGCTTTGCT<br>TGCAAAGATCGACGGCATTCCCTGGCGACTGGACAGGGAGTTGAAACAGGAACTGATCGTAGGCGTCGGCGC<br>CTATAAAAGCAGCGTCACCAACACAAGGTTCGTTGGAAGCGCCTTTTGCTTTAACAACAAAGGAGAGTTCAA<br>GAGCTTTGACTGCTTCAGGGAGAAGGAATTCGATCTGATTGCCGGGAAAATCGGCAAGCAGGTGCTCACCTT<br>CATTGAGGAGAACGAGAACAAGTTGGAGAGGCTGATCATCCATTATTTCAAGCCTTTCAACAAGGATGAGAT<br>AGATCTCGTGCAGGAGACCCTCGGCCTGCTGAAGCTGGAAATCCCCATCATCATCGTGACTATCAATAAGAC<br>CGAGAGCTCCGATTACGTCGCTTTTGACACCAACGACGACGCCCTGATGCCCCTGAGCGGCACCATTATCGA<br>GATAGCACATCTGAAGTATCTGCTGTTCAATAACGCGAAGTACAGCAGCGCATCGGCTTCGCCAAGACCACCC<br>CTTCCCCGTTAAGCTCAGTCTGTACTGCACCGACCAGGATTACTTCGAGGACATCGCCATCGTCAAGGAGCT<br>CATAGATCAGGTTTATCAGTTTTCTAGGATGTACTGGAAGAGCGTCAAGCAGCAAAACCTGCCCGTGACAAT<br>CAAATACCCCGAGATGTGGCCCAAATCTTCCCACACTTTGAGGGCGATAAACTGCCTGATTTTGGAAAAAA<br>CAATCTCTGGTTTCTGTAGTAACTCGAGGTTAACTTGT |

TABLE 19-continued

Argonaute nucleic acid sequences containing 2 nuclear localization sequences and a cloning sequence

| SEQ ID NO | Argonaute | Sequence |
|---|---|---|
| 315 | 77 (Helicase) | GGTGTCGTGAGGATCCATGCCCAAGAAAAAGAGGAAGGTTGAGGACCCCAAAAAGAAGCGCAAAGTAGGTAG<br>CGGCTCCATGCTGACCAATAATCAGATTGTGCTGGAGCAGGAACTTCTGGGAAGCATATTCAAAAACAATAA<br>CCTGATGCTGAAAGCCCGAGAGAAGATAAAACCGGAGATGTTCCTGTATAGCAAACACATGAACATTTACCT<br>GGGCATCCTCGACATGGTGGCCAACAAGCTGGAGGTGGACCTGATCACCTTTCTCGAGCACCATAAGAAAAG<br>GGTGGGGGATATGGATGGCGTAACTTACGTGACCGAGATCTACACCTGCAGCGCGTCCGACATTGGCTTCAA<br>TACAAAACTTGACATGCTGGTGAACAACTACAAACGGCATCTGTATGTGGGAGATGAAGGACAAAATCAACAG<br>TGATATGAGTCTTGAGGAGATCGAGAGCGAGGTTGAAGGGGTGAAGGTAAAGGTGCACAAATGCAACATCAA<br>GAAAGAACTGGATATAGACAAGCAATATGACGATTACATCAACTGGCTTTACGACGAAAACAGAGACAAGGG<br>GATGAAAAGCGGCCTGACCTATCTGGACAAGTATCTCGGCAACTTCCAGAAGGGCAGGCTCGTCACCGTGTT<br>CGCCAGGAGCGGCGTCGGCAAGACCACGTTCAGCTTGCAGCTGGCCGCCAATATGGCTCTGAAGGGCCACAA<br>GATATTCTACGGGAGCGCAGAGATGACCCGCAACCAGGTCTTTAACAGGATCGTGGCCTCAGGTTTGAGCCT<br>TAGCGCGAAGGCGATTGATGAGGACACCATCCTGAAGGAGGACAAGGAGAGCATCGCCAAGTTTATGACCAA<br>GGTTATCAACAACAAGTTCTACGTGTCAACCGAGACCGACTTCGAAAAGTTCATCGACGAGATAAAGGTTTA<br>TAAGCTGCAGAACAGTCTGGACGTGGTGTTCGTGGACTACATTAACAAGTACATCGACTTCACCGACAGGGA<br>CATGTTGACCAACAAACTGGGGAAGATCAGCGGCATGCTCAAGAGCCTGGCCATGGAAGAGGATATCTGCGT<br>GGTGCTGATGGCCCAGGCCAATAGAGTGATTGACAAGAAGGTGGGTGACAATGCCGTCGAAAAAATCGACAG<br>CAGCGACATCCAGGACAGCGCCAGAATCGAGCAAGACAGCGACCAAGTGATCGGCCTGTACCGGAACGTGAA<br>GCTCGATGATAAATGTATAGGGAGAACCTGTTCAATCAGGGCAAGCTCAAGTATAATTCCAAGAACGCCGA<br>CGACAATCCGGAATGCATGAACGCTGTGATCATTAAGAACAGGCATGGCGACCGAGGCACGTGTGCACTGAG<br>GTGGCACGGCAGGTACAGCAGGGTCAGCGACTTCTAGTAACTCGAGGTTAACTTGT |
| 316 | 66 | GGTGTCGTGAGGATCCATGCCTAAGAAGAAGAGGAAGGTCGAAGATCCCAAAAAGAAACGAAAGGTTGGATC<br>AGGGTCTCTTCACCTTAACTACCTCCCATTGCGCTTTACCGCCGATATATTCAAGGGTGGTGCTTTGACATT<br>TCCCGAAGGCAGCGAGAAAAACTGGACCAGCGACGATCCAATCAGCAAGGAGCTGAGCAAGTTGCGAGAGAA<br>ACACGGAGATAGTCATGTCTTCCACCGGATGGGAAACAAAATTGCATGTATCCCCGTTGTGGAGAACGCCAT<br>TGCTATAGGCACCGAGACGGATTTCAACATCATTAGTGACTTTCAGCTGGCTAATGCTCTTGCTCGCAGCGC<br>CCTCCACAGGTACTTCAAAGCTGCGGGAAGGGAACTGTAATTGGGTTCCGACCCGTAACCCTTCTCTTGGA<br>AAAACACAACTTGGCCAGCAACAGGAAGGACGTGTTCGGCATTTTCCCCGAGTACACTCTGGACGTCAGGCC<br>TCTTGCACCACATGAGGGCGACATAGCGAGCGGAGTGCTTATCGGCTTTGGAATAAAGTATGTTTTCCTTCA<br>GAACGTAGCCGAGCTGCAGGCACAAGGGGTGAGTGCCGCAGGGATGTACGCCGTGAGGCTGGTAGACGAGAG<br>CGAACATCAATTTGACCGGGCCTACCTGGGAAGGATTGATCGGTTCACAAAAGATAACGTGACGCTCGTTGA<br>CAGCGATTACGCGGAATATCCCGCCGACCAGTGTTACTTCGAGGGAAGCAGGACCAACATCGAAGCCGTGGG<br>CCGAAGTCTCCTGGGGAAAGACTATGATGCCTTCAGCTCAAGCCTTTTGCAGGAGAGCTACAAAGTGACCGG<br>AGCCCCCAACCAAACCCAACGACTGCACCAGTTGGGCGCGTGGCTCGAGGCCAAGAGTCCGATCCCCTGCGC<br>CGTTGGTCTGGGAGTACGGATTGCAAAAAAGCCGCATGAGTGCTCACGAGGCAACGACGCCGGGTACAGCCG<br>CTTTTTCGACAGCCCCAAGTGCGTGCTGCGGCCTGGCGGCTCCTGTGACCGTGCCCTGGCCGGTCGACAAGCA<br>GATAGATCTCAATGGCCCTTACGACGCTGAGAGCTTTCCCAACAAGAGGGTACGAATTGCCGTCATCTGCCC<br>TCAGGAATTCACCGGGGATGCGGAAGAGTTCCTCCGGAAGTTGAAGGAGGGCCTTCCTAACGCACCGGACGG<br>CAGTCCGTTTCGCAAGGGCTTTGTTCGAAAGTACCATTTGTCTAGCTGTGACTTCACGTTCCATGAGGTTAA<br>GCGGAGCTCAAACAGTGACGACATCTACAAGGATGCGTCCCTTGAGGCACTGAAGCAGAAGCCAGATATGGC<br>AATCGCCATAATCCGGTCCCAATATCGCGGGCTGCCCGATGCTTCTAATCCCTATTACACGACAAAAGCTAG<br>GCTGATGGCCCAGGGCGTACCAGTTCAACTGCTGAACATAGAGACCATCAGGAGGAAGTCTTTGGACTACAT<br>TCTGAATAACATCGGTCTTGCGATGTATGCCAAACTTGGAGGAATCCCTTGGACCCTCACCCAGAATAGCGA<br>CATGGCGCACGAGATCATCGTCGGGATAGGGTCAGCCCGGCTCAATGAGAGCAGGAGGGGTGCTGGCGAGAG<br>GGTCATCGGGATCACGACCGTGTTCAGTGGTGACGGACAGTACCTCCTCGCCAACAACACCCAGGAAGTTCC<br>CAGCGAAGAGTACGTAGACGCATTGACTCAGTCTCTTAGCGAGACAGTATCAGAGCTTAGGAGCCGGTTCGG<br>TTGGCGCCCTAAAGATCGAGTGAGGTTCATATTCCACCAGAAGTTTAAGAAGTACAAAGACGCAGAGGCGGA<br>GGCGGTTGATAGGTTTGCACGCTCACTGAAAGATTTTGACGTGCAATACGCCTTCGTGCATGTGTCTGATTC<br>TCATAACTGGATGCTGCTGGACCCAGCTAGTCGGGGGGTGAAATTCGGCGATACGATGAAGGGCGTCGCCGT<br>CCCTCAGCGGGGACAATGTGTGCCCCTGGGGCCAAACGCTGCGCTGCTTACTTTGAGCGGTCCGTTCCAGGT<br>AAAGACCCCACTGCAAGGCTGTCCGCACCCCGTGCTGGTGTCAATTCATGAGAAGAGCACTTTTAAGTCTGT<br>TGATTACATAGCCCGCCAAATCTTCAATCTCAGCTTCATCAGTTGGAGGGGCTTTAACCCTAGCACCCTCCC<br>AGTGTCCATTTCCTACTCCGACATGATCGTAGACCTCTTGGGACATCTTAGACGCGTTAAGAATTGGAATCC<br>GGAAACCCTGTCTACCGCTCTTAAGGAACGAAGGTGGTTTCTGTAGTAACTCGAGGTTAACTTGT |
| 317 | 15 | GGTGTCGTGAGGATCCATGCCCAAAAAGAAACGCAAGGTCGAGGACCCTAAGAAGAAGAGGAAAGTAGGGTC<br>TGGCTCTATGCAACTGAACTATTTCCCCATCCAGTTTGACTTTTCTGACTACCAGGTCATCACGCAGCCCTA<br>CTCCGACGAGAGATTGAAAGAACTCAGGCAGGCCTACAACGCCAGCTATTCCTTCTTTCGGGACGGCAACCT<br>TATCGTAATTTCCAATAAAGAGGACGAGGAAAACCAATTGACGGGCAACGTCGAAAACCGCAGCGTGTTCGA<br>CGATGCCAAAGTTACCGCCAGCATGGTCAAGCATATATTCTTTAGGACGTTCAAGGACAGGTTCCAAGGCTT<br>CATCCCCGTGGACTTTTACCCCTTCCGATTCTACAGCAAGAAGGACGACCTTATTCTGAACCACCT<br>GCCCGAAAAACTTAAGCATAAAATCGCCTTTAAGAAACTGATCGAGGTGCAGCTCAGGGAGACGAATCTTAA<br>TTCAACCCAGGGCTTTGCTTTCGTCGTCAACATCAGGAGAATTGGGTGTTTAACATTTCCTGTCTCGAGCT<br>TTATCAGGAAGGCTTTGACCTCACAGATTTTGAAGTGCTCCATGCGGAGACGCTTCCCGGGTTGGACAATAT<br>CCTGGCCCCGAACGAGGACTTCGTTGGCCTTCTCAAGAGCATCAACGGCGAGACTGCCATTGTGAGCACTAG<br>CGAGGGTGCCCGCTCCTATTCACTGCAGGAGCTCTTCATTCGCAAGACTAAGCACAACATACAGGCGTACCT<br>CAACTTCGCCACCGGGGAAAAAAGTGCGACCAGATCCTTGCAGCCGTGTCCCAGGAACGAATCCGGAAGCA<br>GAACCCCGTGAATCAATTCAGCGAGATATCCAACATCGCGAAGCATCTTTTTTCAGACAAAGGCAATCCAGT<br>GCTGTTCCAGAATATGGATGGCTTTTGTTTTAAAGTTGACACCACGCCGATGCAGGTACAAAATCCATGAA<br>CCTGCAAACTCCCACGTTCATCTACGACCACGCGGGTACCAAGACGAACACCCGCAACGCGGACCAGGGGCT<br>GAGCTACTACGGCCCCTACGATAGCCTCACCTTCGACATTAAGAAGCCAAGAGTTCTCTATCTGCCATAA<br>GACCAACCGAGGCTCCTTTACGCGCTTCCTCCACGACCTCAAAGACGGGCTCCCCAATAGCAGCTGGTTCAA<br>GAAGGGCCTCCTGAAGAAGTACGAGCTTCAAGAGGTGAATTACCTCATCCAGGAGATCAGCGACTACAGGTT<br>GGAGGACTACCTGGAAGTGATCTCAAACTACGATGATGAGAAGCCGCACCTGGCAATCATCGAAATTCCAGA |

TABLE 19-continued

Argonaute nucleic acid sequences containing 2 nuclear localization sequences and a cloning sequence

| SEQ ID NO | Argonaute | Sequence |
|---|---|---|
| | | TAGGTTCAAAAAACTGTCCGACCGGGACAACCCCTATTTCAAGATTAAGGCAAAGCTGCTGAGCCTTGAGAT<br>TCCCGTACAATTTGTGCGCAGCACGACTTTGAGCAGCTACAGCGAATACATACTTAATCCGCTTGCATTGCA<br>AATCTATGCGAAACTCGGCGGCACGCCTTGGGTTCTTCCGGCCCAACGCTCCGTTGACCGCGAAATCGTTAT<br>TGGCATAGGTCACTCATGGCTTCGGAGTGGCATGTATAAGGGTGCTGAAAACAGCAGGGTGGTCGGCATTAC<br>TACGTTTATGTCTAGCGATGGCCAATACCTCCTGGGCGACAAGGTGAAAGACGTGCCTTACGAGTCTTACTT<br>CGAGGAGTTGCTGAAGAGTCTCAAAAGTAGCATAAGCAGACTCTCCGATGAGTATGCCTGGCAGGATGGCGA<br>CACAGTGCGCCTCCATTTTCCACATCTTCAAACCCATCAAGAACGTTGAGTTCGATGTCATTAGCCAGCTTGT<br>GAAGGACATCAGCCAGTTCAACATAAAGTTCGCGTTTGTGACCATTAGCAAGTCACACCCGTCTATTCTCTT<br>TGACACGAGTCAGCAAGGCGAGAAAAAGTACGGCTCTAACCAGGTGATAGGGCAGTACATCCCTCAGAGGGG<br>TAGCAATATCTTCATAGATGACGAAACCAGCCTGGTGCAGATGCTGGGCGCCAGGGAACTTAAAACTGCCAA<br>ACACGGGATGAGCACCCCAATCCAAATCAAACTTAGGACACCGCAGGGTAACCATAACGACCAAGAACTGAA<br>GGATTTGATGTTTTACGATCTTAACTACATTACCCAGCAGATCTATAGTTTTACTTACTTGAGCTGGAGGAG<br>CTTTTTGCCACGCGAGGAACCGGCCACAATGCTCTACTCCAACTTGATATCCCGACTTCTTGGGAAGATGAG<br>GAGCATCCTGAATGGGATGCGGATAAGCTCAATTATACCCTTAAAAGGAAGAAATGGTTCCTGTAGTAACT<br>CGAGGTTAACTTGT |
| 318 | 22 | GGTGTCGTGAGGATCCATGCCCAAGAAAAAAGAAAGGTGGAAGACCCTAAGAAGAAGCGCAAAGTGGGATC<br>CGGCTCTATGTTGGAGACGAATATCAGGGTGGTGCGGCCTGGTCCGCAGCTGTGCGTTCCTGTACGCAGGGT<br>GATCGTGTCCGGTCAAACCTTGGCTCCCGACCTCCTGGAGAGGCTGTGTAACCTGCTGCGAAGGAGGTACGG<br>CATTAGCGCCGCAAGAATACCGGGCTCCGTGAGCGAGCTGTTCGTTGCGACCGACCGGCAGGTGGAGAAGGT<br>GACACTGGAAGAAGATAACTGGCAACTGACCGCCGTGGACTCCAACGACCCTACTCGAATCATGTCCATCTC<br>TAACACGGACGATGAGAGCTTTATAAGCATCCTGATCGAACGCGCGCTCCTTGCCCAGATCGCCAGTCGAAG<br>CCTCTTTTGGACCCTCGACTCTCCTCGAATTTGGTATGAAGAACCCGTTCCAAAGGAATGAAGGCGTAGC<br>CGTCTACCACAGGTACGAGGTGGATGCGCTCCCCCTCGGCGACGCAGGCATTGGCATCTCAGTGGATGTTTC<br>AACGGCCTTTTTTAGCGAGCACACCCTGGAGTACTACTTCGCCCCCAACCTGATTAGCGGCGAGAGCAAGAC<br>GCGACAGGACGAATTCCACAAGTTCACCGGCCGACAAGCTGGTCAAAAGGGGACGCTGCTTTACAATAACGG<br>CAGGAGTAAGGTGAAGTGCTATTTCGAGAACAATAGGGTGGGCCTGACATGTGGCGCAACCGGCCAAATGAA<br>ACTCGAGGGAATCACGTATCCCAGCCTGTACCACTACTATGCGAGCAAGTATAGCGCATTGCAGATCAACGA<br>GAACGATGCCGCAGTCAAGTGTCTTTCCCTGGCTTGGACCGCCCAGTTCCGGTAGCCGCCAGGCTCCTGTC<br>CCTCCGAGTGATGAACGACGACGTGCCCGATGGTCTGAGCTCCGTCGACAAGATCCCTCCAAGGAACCGCAA<br>GTACCTTATCGAGCAGTTTTGGAAGTGCCTGGAGCCGAGACCCTTCGGGAATGTGGCCCCTGGTGTCTTCGA<br>CGGCTTCTGGAGACCCAACAACGAAAGGGTGCATTACATCCGACTGCCCGAGATTAACTTTGGACAAGGCCA<br>AAAAGCAGAACCGCCTGACGTACGCTCCGTTGCATCCATCAAAAACTATTTTAGGCGACGACTGGAATTGCT<br>GGGTCACGCGGGGTGTTACCACTTTCCGCCCTCAGCCCCCAGGACAATCTTCTGCGCCTACCCGCAGTCATT<br>GGGTGAGGAGATCCCGGAAAAGTTGGTGAACGGGATCGTCAATGTGCTGAACAAGTGGACCGGCCTCAGCTT<br>CTGTAGCAACCTGGTAAGCTACAGCACGGCCAGCGAGGCGTCACCCGGGAAGTCGAGAGTGCCGG<br>CGTGGTCCTGTTCATCTTGGACGAGGAGCCGGCAGTCTACTACGACGCGAGCTTCAATCTTGAGGGCTGGAG<br>GGTAAAGCGCGTAACCGAGCCTGTGCTGCGCCAGCAGCATAAGTATCTGACCAACGGCGTGTGGGACCGGAA<br>GAGGCAAGAGTATAGTTTGGGGAGGGGCAGAGTCGCTGGGAAAGCTTCATCAATTTGATCGGATTGGACGT<br>TATCCAGCAACTCGATGCCATTCCGTATAGGATCCCCAACATCGGCCCCTACGAAGGCCAGCTGATAATCGA<br>CGTGGGGCATGACAGGCAATTCTTCGCCGTGTCACTGCTTATTGTGAGATCAGAAGACAAAGTGCCCGCATT<br>TAACATCAGCAGCCAGGTCCAGCACAAGGCGGATCATAAGCACGAAAGCATTAACCCGGTGCTGTTGAAGGA<br>CACCATCATTAACGTGTTCAAGACCGCCAAACGGAGGACTTTTGATCCTCTGACTAGCCTGTTGATCATGCG<br>GGATGGCAACGTGCAGGGCAGCGAGATCGGCGGGATAGACAACGCCCTGGTCGAACTTAGGCAACTTGGCAT<br>AATCTCCCCGATGCGAGGCTGGACATCGTGGGCGTACACAAGGAATCTGTAAGCTCCATCAGGCTCTGGGA<br>CGTTGACGTAAGGGGGGAGGTAAGCAACCCGATCGAGGGCACCGGTCTGTCAGTCAACTCATCTCTGTACCT<br>GGTGGCGTGCACAGGTGAGGCCACGCTGACCCAAGGCACCGCAGAGCCCGTGGCCATCGTCGCAAACAACAG<br>GTGCCTGAGTATTGCCGATGCAGCCCTGAGCGCCTTTCTGGCAGCCCAACTGAACTGGAGCAGCCCGGGAGT<br>CGCCCAGCGCCTGCCCCTGCCTCTGAAAAGAACAGATGAGGAACTTACCGCTAGGAGCGATCAAGAAATTAG<br>GAGGATAAGGTAGTAACTCGAGGTTAACTTGT |
| 319 | 32 | GGTGTCGTGAGGATCCATGCCCAAGAAGAAGAGAAAGGTGGAGGACCCGAAGAAAAACGAAAGGTTGGCAG<br>CGGCAGCGTGCAGCAGACAGTGGAGCTCACCCTCTACACAGAAAAACATCCCGACACCCACCCAGAGCTCGT<br>TTATGCCGACGAGTGTCCCGACCTGTGGCAACAGCACAGCGAGCTTACGGGGACAAATCTCTGTTCTACTC<br>TCTTACGAACCCGGCAGAATGCAAGGGAACCCAGTACACAGTGCAAATCAACCTGAATAACCAGAAGCAGCG<br>AAGGATCGCCAAGCACATAATTAGCCAGCAACTGTATAATCACTTCCGCCAGACCCAAATCGCTACCTTCGA<br>CAAGATCGACAATGTGGAGGTGTGGACCAAGAACACCCAACAGCCTACCCAGAATTGCACGGAGTACCTGAG<br>GTTCAGCCTTATACCCCAATACGCCGTGTTCTCTGACTCATGGGAGCTGGTCGTGTCCTCAAATGGCATATC<br>CACCGTGTATAACAAGCCTTTGAGCGCACTGGACCTTCAGACCGACCGATTCAAGGTCGTCGTTGGAGGGGA<br>AGTGGTCAAGTACAAGAACCTGAGCCCCAATCAAAAGCAACAAATAGACGAGGCCTTCCCCAAAATCAATAG<br>GGAACTGGCCGCTGAACTGCATATTAACGAGAAACGCTTTCTCAATAAAGACAAGTATACGACCACCTACAA<br>CCACATTAACAACTTCGTGCGACAGCACCCTTCTCACATCCGAGTTCCAGGCACTGTTTTGTCTGAGCGGCGA<br>GATGTTCAACGTACCCGAGGAGCGGATCGGCCAAGTGGCGAAGGGGCGAACCTGTTGCAGTTTAAGGACGG<br>CAAGACCGGCATTGACCCATTCAGCTGTGTGTTCGGCAGCAAGAGCATGGACGCACTCGGCATCTACCAACC<br>CAGCCTGAAGCCCCAGGTGAAATTCTTTTTCATCGCCCAGCAAAGCGATATCAACGTGTGCAAAAGCCTGTA<br>CGATATTTTCACGAAGGGATACAAGCCCTACGTGGACACAGCCACTGGCGAGCAGAGGTACGTGTTCCCACC<br>CCTGGCGACGTGCATCAAGCAGCCCTTTTCAACCGACCCCAAGGGGAGCATTTACTTCAGCGACCCTCAAA<br>TGCCCTGAGCGAGATCAAGAGCCAGCTTAACAATAAGCCTCTTGACCCCCAAACGCAGTATGTGAGCATATA<br>CGTGTCACCCATCCCTCGCGACGCCGTCAACAATCCCTACTACGGTCTGTACTTTCAGATTAAGGAGCTGCT<br>GCTCGAAAAGAGGATAACGTCTCAGGTGATCTATAAGGACCGCCCCAACAACCAGTACTTCAACTTCCATCT<br>GCCCAATATCGCGACTGCCATCCTGGCAAAAATAGGCGGCATCCCGTGGCAGTTGAACTCCCACACGACGAA<br>CAAAGATCTGGTGATAGGCGTGGGCGCCTTCCTTAGCGAAAAAGTTGGCGAGAGGTATGTGGGCAGCGCGTT<br>CAGCTTTAACCCCAACGGCCTGTTTAAGAACTTCGACTGCTGTAAAGCGAACGATCTCGAATCTATCGTAGC<br>CGGGATCAGAAAGGCCATCGGACACTTCGTTGTGGACAGCGAAACAAACCCCCAGAGGCTGATCATCCACTA |

TABLE 19-continued

Argonaute nucleic acid sequences containing 2 nuclear localization sequences and a cloning sequence

| SEQ ID NO | Argonaute | Sequence |
|---|---|---|
| | | CTACAAGACCATGTCAAAGAGGGAGGCCAGGCCCATCACGCAGATGCTGAACACGCTTGGCCTCAACATTCC<br>TGTATTGATCGTCACAATAAACAAGACGGAGACCAGCGACATTGTTATGTTTGATGAGAAACAGCAGGGCTA<br>CATGCCCCTTTCAGGCACCGTACTGAAGATAAGGAACGATGATTTCCTGCTCTACAACAATAGCAGGTACAA<br>AGAGAACGAAAAGTCAGATATGCTTTTTCCAGTGAGGATCCGCCTGAGTAAGATCGTAAACCAATCCGACAA<br>AGACATCCCAATGACAGACGCCTTCAATTTGCTCAACCAAGTGTACCAGTTCTCACGCATGTATTGGAAGAG<br>CGTTAAGCAGCAAAACCTGCCGATCACGATAAAGTATCCAGAGATGGTGGCCGAGATAGTGCCACACTTTTC<br>AGAAGCCGAATTGCCGCAGTTCGGAAAGAATAATCTGTGGTTTCTGTAGTAACTCGAGGTTAACTTGT |
| 320 | 91 | GGTGTCGTGAGGATCCATGAAAATTATAGATAAGGAAACCTTCATCAGAAGTTTTAAAGTTTTGAGCAATCA<br>ATCCTTTGACCTGTTCCTGGGCGCTGGCGCCTCCATATCTAGCGGTATCCCTTCCGGAGGCGACCTCGTCTG<br>GCATTTTAAGCGCGAAATACTGAATTCCAACGGGAAGATAAATATTTAAAAATTTCAAGATCTTAAGATAGA<br>AGATAATAAGAAGGTTATACAAAGTTTCTTTGAGGAGACTGAGGAGAACAACATTATTAATCCTTATTCCTA<br>TTATTTTAACAAATGTTATCCAGACCCCTTGATAAGAAAAGAATTCTTGACGAATCTTGTGAGGGACAAGAA<br>GCCTTCCATAGGATTTATGTGCCTGTCTGCTCTCGTGGAGCAGCAAAAAATCAACACAGTATGGACAACTAA<br>CTTCGATGACTTGATTGAGAAGGCGATTAACGGATTGAATTACAAGTCCTGTCAAATTGTCTCACCCGAGAA<br>TGCGGGCAGCGTGAATAACTTTCGAACTGATATCCCCACTGTTGTTAAGCTTCACGGAGATTTTAGGTATGA<br>CCCACTGCAGAATACTGACGAAGAGTTGCAGAAACTGAAGAGTCCTTGCATAAGTATTTCGTAGAGGCAAG<br>CACAAAGAGGGGACTTCTCGTAATGGGCTATTCTGGGTCAGATGAGTCTGTGCTGCAAAGCCTTGAGAAGGC<br>GCTGGAAGAGAACAACGCGTTCCCTAAGGGACTCATTTGGTGCATCCCCAAAAGTGTCACCCCAAACCAACG<br>ACTGGTCCGAATTATATCTAAGGCTAATGAGCAGAACCAGCGGTCCGGATTTATGATTATCGACAGTTTCGA<br>TTATTTCTTGCATGAACTCTACAAAATATGCGACCTTACGAATGACTATATCGACTCTATTACCAAGGAGAG<br>ATTTGAAAAAGGCAGTCATTTAGGCTTAACCAAACTCCGTCCTCTACTCTGCCAATCTTGCTGAACGCAAT<br>AAAAGCAAAGCACTTCCCGAAAAGTACCTTTCTGACTAAAACGAATATCTCAGGCATAGGTAAGTGGAAACG<br>CTTGCGAGACGCTATAGGAAATAGCTCTATAGTCGGATCTTTCGGTAAGAACGATTCTCTCAGACTTTTTGG<br>AAGTGAACAAGACATTAATAATGTACTTAAGAACTACTTGATTGATGATTTGAAGATCAGTGATATCCCAGA<br>GCACCTTTTTTTCCATTCTGATTCATTCTACATTGGCATGCTTTATGAACTGATTGAAAAGTGTTTGATTAA<br>AGATTATGGGCTGTCAGTATATGCAAAGGGGAGAACTATCAGAAAGTTCTATTCAATCAATAACCCGCTGCC<br>GGAATCTGAAATCGCAGATATTAAGAAGAGAAACAATAATTTTAACATCGACAAAAATATAAATGTATTTGA<br>GGCGTTCGAGTTCTCCATAGAATTCATTAATAAGGAGCTGTTCCTGTTGCTGTGTCCCACCATACATATTCA<br>GACTAAACTCGGAGGTGAGGTCAATCGCAATATCTCTCAGTACCTGTCAAACACAATCATCAGCAATAGGTA<br>TAATAACAAATATGGGAAAAAGCTGAATTGGTGGATTAACGAGCTCAAGAAGTATAACAAGGACTTGGTTTT<br>TAAATTGGGGGACTTTGAGATACGATTGACAGATTATTACTCCACGAGCGCTAAGCGCGTTAAAGATGACAT<br>CTACTGTTTTGACGGATTTACTAAGTTGAGTGAGCCCAGTATATATTTCCACTATCAAGACGAAGCAAAGCA<br>GAGTATCCATCCCATAAGTGGACTGAAGATACTCGGTCCATTGGAAGAATCATTCGAGGCAAACGGTACATC<br>TTCCACAGTCAACCTTGCCATCATTACTCCGGACTTTGGCTTCTCCAAACTCAAGGCGCACCTCGAAAGTTT<br>GCTTAATACAATTTCCCCTATATGGGAGAAGGAATACTTGAAGGAGTTCCCTGGTTTCGATAACGTTTTTAA<br>GAAGCACCTGATAATACCCAATTCTATTCAAAGCGAGTATGTAATCAGCATACCTAATAATGATGTAAAACA<br>GTTCTCAGCAATTCAATTCTACGACTACCTGAAGAGTAAGATCGACCGACTCGCTCTGAAGTCCAATGACAT<br>TGATTGTCTTGTAATATACATACCCGACCAGTGG+AGAACTTCCGAGAGCTGAAAAATGAAAACACATATTA<br>TGACCTTCACGACAGTCTTAAACTCTACTGCGTAAAAAAGGGGTTGCGAATCCAGTTCATCGAAGATAAAAG<br>CATTAATTATAAAGACCAAGCCAAGATCCGGTGGTGGCTGTCTCTGGGGCTCTACGTGAAGTCTAACGGCAC<br>TCCCTGGAAGATCAAAACAGATAATACAGAGACTGCCTTTGTGGGCCTCGGTTACGCTATACGACAAAATGT<br>TAAGAATAAGGTTGTTCTCGGGTCTTCACAGATTTTCGACGGTTATGGGAATGGTCTCAAGTTTCTTTTGCA<br>GCCCATAGAGAAGCCAATTTTTTACAATAAAAACCCCTTCATGACAAAGAGGACTCTTTTCGGCTTATCAG<br>TAATATACGAAACACATATCATAAGATCGATCCAGTTATCGGACTTAAGAAACTCGTGTTGCATAAGACAAC<br>TCATTTTACTTCAGAGGAGATGGAGGGGATCTCTAATGCTTTGGAAGGCATAGACAATATTGAACTCTTGCA<br>GATTCAGCAATTCTCATCATGGAGGGCAATTAAGCTTATGAAAAATGCCACAAAGCACGATTTTAATGGTTA<br>TCCGATCGATCGCGGAACTATAATTCAACTCGACGACTTCTCTTTCCTTCTGTGGACACACGGGCTTATAGA<br>GAACCAAGAGCTGAACGGTAAGTACTACCAGGGAAAAAGAGGGAATACCGGCTCCGCTTCTTATTAAGAGATT<br>TAGAGGCACGGATCCAATAGAGACGGTGGCAAACGATATTCTTAAGCTGACCAAGATGAATTGGAATGGTGC<br>AGAGCTCTATAAAACCTTTCCTGTAACGATTGATTTCAGTAAAAAACTTTCAGTCATGGGGAAGTAGTAACT<br>CGAGGTTAACTTGT |
| 321 | 0 | GGTGTCGTCACGATCCATGCCAAACAAAAACAGCAAACTCCACCATCCCAAGAACAAACGCAAGCTCCGTTC<br>CGGTTCTATGCCTTCAGCTCAACGGTGCATCTGGGAGTGGAAGAGGGATATCTTCGTGACCAAGAATCCGAC<br>GCTCCGGCAGTCCGTGGATGAACTTAGCTTGCCAGGGACCAGGCGCATCGTACAGGGATGGATCGACCAGCA<br>AGCCCAATACCCGGAAGATGGGTCAGCAGCAGAATATAGCTTTTATGCCGAAGAGTGCTACCCAACCTCTCA<br>TGACCGGCGAGCGTTCTTCCATCGCTTCATTGCCGAGGCGAGACCGCATATCGGCTACAAGCTGGTTGCGCA<br>GrTGGCAGAAGCAGGGTTCTTGAGAACCATTTGGACGACCAACTTTGACGGACTGGTTAGCAGAGCGTGCAC<br>AGCGGCTAACGTCGTGTGCGTGGAAGTGGGCATGGACACACCCCACAGGGCCTCACGACCGCAAGGGGATGA<br>CGAAGTCAGACTGGTGTCCCTCCACGGTGACTTTAGGTATGACCTGCTGAAGAACACCGCCAATGAGCTGCG<br>CGAGCAGGATTTGGCCCTTAGGGAGGAACTGCTGCACGAACTCAAAGACTACGACCTGGTGGTCATCGGATA<br>TTCAGGGCGGGACGACAGCCTTATGCAAGTGCTCTCTGCTGCCTACAGCGACCCGCGCATCTTGTAGGCTCTA<br>CTGGTGCGGGTTTGGCGCGGAACCAGCACCGGAAGrGAGGCACCTTATTAAGAGCATCGACCCAGCCCGAGA<br>GAGCGCGTTCTACGTGGATACCGCCGGATTTGACGTAATGAGCAGGCTTGCACTCAGGCGACTGAGCGG<br>TGAAAGCCTCGAAAGGGCCCAGAAGCTCATAGAAAGCGTCACCCCGGTTGCTGGCAAAAAGATGGCCTTTAG<br>TGTTCCACCATTGGCCCCTAGCGCCTTGGTGAAGGGTAATGCCTACCGATTGACCTGTCCGGCAAACGTCTT<br>GAAACTTCATATCGAACTTCCCGAGCACGGTTCCTGGCGCGATTCGCTGTCCGAACGAATCACTCCACAAAG<br>GGGGCAGGCCGTTGTGTTCGAGAAGGGAGCATGCTTGGCCGACATGGCGGTTACCGCTAAAGTTTTCGA<br>TGGATTTCTTAGGGTGAGCCCGACACGGGTGGAGATAAGTGACGAGAACATCATCGTGACGGCCGGATCGC<br>CAGTCTTTACCGACGAGCTCTCGTGAGCAGTGCCGCAAAAGCGCTCCAGATCCAAACCGACCACAGGAGGAG<br>GATATGGGAGCCCGTGCACTATGATACAAGGCAACrCGACGATGTGACGTACCGCGTGCATCGAGCCGTCTC<br>CCTGACGATAGTAGGGATAGAGGGAGTGCCCCATGrGGTGCTGATGCCAGAGGTCGTCGCArCTACGTTGGC<br>GGGCGACCTTGCGCCGGTTGACAGTCAAAAGACTCTCCGCAATGCCATTTACGGGTTCCAACATAACGATAA |

TABLE 19-continued

Argonaute nucleic acid sequences containing 2 nuclear localization sequences and a cloning sequence

| SEQ ID NO | Argonaute | Sequence |
|---|---|---|
| | | GTTTGATGCCGACCTCAGCTATTGGACCCACCGCCTTGTTGAGAAGGAGCTGGCTTCCAGCGGCGAGGGCGT<br>TTTCGrATTGAGCAAAGTGCCACTTTATGCGGGCCrGGCACAAAAAGGTAAAGCTCCTCTCCCACACAGGTT<br>TGCACGCCACGCTAAACAGCATGGAArTATrGTGCCCGACGCACCGCTTGTTTTCAGCGCCAAGGrTGGCTC<br>TGGAGAGGTACGAAACCCCAATCCGCTGCATGGGCTGGTGCAAAACCGGCCATGGGACCACTCTCTTACGGC<br>GTCTGGTTTGTGTCCGAGTACAGATGCTAGCGTGATCTGCCCCGCAGACGCTGCTCCGAGGTTTGAGAGATT<br>CCTCCAATCTATGCAGGAGGTAGCAAGACCAAGCCAGAGCGAGACGGACTATTTGCATGATTTTCCCGGCTT<br>CCCTGCGGCCTTTGGACTGCCACTCCGAATGCCCGrGAGAGGGGACGCAAACTGGATTACCATCGACGACGG<br>AGTGAGCACCGATGCCCTGACAGGGGCTAAGCAACTGGCGCACCGAGTGTGCCAAGCACTCGACCACCTCCG<br>CAGAGCAAGGCCCTCTGACACGGCGATCGTGTTCGrTCCCAGGAGATGGGAACCATATAAGGTAGrGGACAC<br>GCAGCACGAAAGATTCAATTTCCACGATTACATTAAGGCCTACGCGGCCAGGCACAGTCAGAGCACGCAGTT<br>CGTCAGAGAAGAGACCATCCAAAGCCAATACGTGTGTAGGGTCCGGTGGTGGTTGAGTTTGGCACTGTATGT<br>TAAGGCTATGCGGACCCCCTGGCGGCTGGATGCGCTTGATGAGAATACGGCTTTTGTTGGTATAGGGTACTC<br>CCTGGACCCAGACGCAGGGACGGGCAACCATGTACTGCTCGGCTCCAGCCACCTGTATTCTGCGAGGCGTGA<br>GGGATTGCAGTTTAGGCTGGGCCGAArCGAGAATCCCGTGGTGCGAGGAAGGAACCCCTTCATGAGCGAGGA<br>CGACGCAAGGAGGACCGGAGACACCATCCGGCAGCTTTTCTACGATAGCAAAATGCATATTCCGACAAGGGT<br>GGTGATACACAAGAGGACAAGGTTCACTGACGAGGAGCAGAGGGGGTTGGTACAAGGATTGGACGGTGTGAG<br>GAATATCGAGCTGATAGAGATCAACCAGGAAGAGAGCTTGCGATATCTCAGCAGCCAGATGAAGGACGGCAG<br>ATTTGAGATCGACAAGTTCCCCCTGTTCAGGGGTACCACAATAGTTGAGTCAGATGACACTGCATTGCTGTG<br>GGTGCATGGAGCCACACCCAGCGCCGTGAACAAGTACTGGAGGTACTACCAGGGGAAGCGCCGCATTCCGGC<br>GCCATTGAGGATTCGAAGGTTCCTCGGGCAAAGCGACGTAGTGCAGATCGCGACCGAGATCTTGGGACTGTC<br>TAAAATGAACTGGAATACGCTTGACTACTATTCAAGGATGCCTGCGACTCTGGATTCTGCAGGCAGTATTGC<br>CAAGTTCGGGTCATATCTTGATGGGTTTACGAGCGCACCCTATGATTACAGACTTCTGATCTAGTAACTCGA<br>GGTTAACTTGT |
| 322 | 6 | GGTGTCGTGAGGATCCATGCCTAAAAAGAAACGCAAGGTAGAGGATCCCAAGAAGAAAAGGAAGGTGGGGAG<br>CGGGAGCGTTCACGCATTGCTCGCTCTGCTCGCGAACCGAGCCGGTGGAAGGACCGCCAGAATGGGAGACAG<br>CTTGCTCACGTGGAGCCCTCCTGAGTCTCTGCTGCTTGAAGGGACCCTGAGCTGGCGCGGCAACACCTACAC<br>ATACCGGCTTCGCCCACTGGCGAGAAGGGTGCTCAACCCTAGGAATCCCAGTGAGAGAGACGCCTTGTCCGC<br>GTTGGCGCGACGACTCCTCCGAGAAGTGCTTGAGCAATTCAGGCGCGAGGGGTTTTGGGTTGAAGGTTGGGC<br>CTTTTACAGGAAGGAGCACGCACGGGGTCCCGGGTGGCGCGTGCTGAAAGGTGCGGCGCTGGATCTGTGGGT<br>TTCAGCCGAGGGGGCCATGGTATTGGAGGTGGATCCGACTTATCGAATCCTGTGTGACATGACACTCGAGGC<br>GTGGCTTGCACAGGGACATCCACCCCCGAAACGCGTCAAGAACGCGTACAACGACAGGACATGGGAACTCCT<br>GGGTCTGGGTGAGGAGGACCCGCAAGGCATTCTTTTGCCAGGCGGGCTGAACCTCGTCGAGTACCACGCTAG<br>TAAGGGCAGAATCAGAGACGGCGGGTGGGGTCGGGTTGCGTGGGTGGCAAATCCTAAAGACGCCAAAGAGAA<br>GATCCCGCATTTGACGAGCTTGTTGATCCCCGTCTTGACCCTGGAAGACCTGCATGAAGAGGGGGCTCTAA<br>CTTGGCCCTCTCCATCCCGTGGAATCAAAGGCAAGAGGAAACCCTTAAAGTGGCCCTGTCCGTGGCTCGCCG<br>ACTCGGCGTCGAACACCCCAAGCCCGTCGAGGCCAAAGCCTGGAGGATGAGGATGCCAGAGCTTCGCGCACG<br>ACGCAGGGTGGGTAAGCCAGCGGACGCCCTTAGAGTGGGGCTGTACCGGGCTCAAGAGACTACCCTCGCACT<br>GCTTCGGCTCGATGGCGGCAGAGGATGGCCTGACTTTCTGCTTAAAGCATTGGAGAACGCTTTTAGGGCCAG<br>CCAGGCTAGGCTTCATGTTAGGGAAATCCACGCAGATCCTAGCCAGCCCCTTGCATTTAGAGAAGCTTGGA<br>AGAAGCGAAAGAAGCAGGTGTGCAGGCTGTCCTCGTACTCACCCCCCCACTGAGTTGGGAGGAGCGACACCG<br>CTTGAAAGCACTGTTCCTCAAAGAAGGACTCCCAAGTCAACTTCTGAACGTCCCCATACAGAGGGAGGAAAG<br>GCATCGGTTGGAAAACGCCCTGCTCGGGCTCCTGGCGAAAGCGGGTCTCCAAGTAGTCGCCCTTGAGGGCGC<br>ATACCCTGCTGATTTGACAGTTGGATTTGATGCCGGAGGCCGCAAGTCCTTTAGGTTCGGAGGTGCCGCATG<br>TGCTGTCGGCTCCGACGGAGGTCACTTGCTGTGGAGTCTGCCGGAAGCCCAAGCGGGCGAACGGATACCAGG<br>CGAAGTAGTTTGGGACCTGTTGGAGGAGGCGTTGCTGGTGTTTAAGAGAAAAAGAGGGCGGTTGCCCAGCCG<br>GGTGCTTCTGCTGAGGGATGGCAGGCTTCCCAAGGACGAGTTCACCCTGGCACTTGCAAAGCTGAGGCAGCT<br>CGGCATTGGCTTCGACCTCGTGTCCGTAAGGAAGAGTGGAGGCGGAAGGATTTATCCGACCCGGGGAAGATT<br>GCTTGACGGCCTTCTGGTGCCCGTTGAAGAGAGGACTTTTTTGCTCCTGACGGTGCATAGGGAGTTCAGAGG<br>CACCCCACGGCCCCTCAAATTGGTACACGAAGAAGGTGAGACACCTCTGGAGGCTCTCGCAGAGCAGATCTA<br>CCACCTGACGAGGCTGTATCCTGCATCAGGTTTCGCATTTCCCAGACTGCCCGCACCCCTGCACTTGGCAGA<br>TAGGCTCGTGAAAGAGGTGGGCCGATTGGGCGTGAGGCATCTCAAGGAAGTAGACAGGGAAAAGCTGTTCTT<br>TGTATAGTAACTCGAGGTTAACTTGT |
| 323 | 50 | GGTGTCGTGAGGATCCATGCCGAAAAAGAAGAGGAAGGTTGAAGATCCCAAGAAGAAACGAAAGGTGGGGAG<br>CGGCAGCGTGAGGCTGGTAAACAGAAAGAGAAACCGGAAGGCGACTACGTGTATGGCTACACTCTCCCAAT<br>AGACCCCAGTAACAGGAACATGAGGCAGCCCTTCTGGATAAGCATGGATAAAAAGGAGGGCTATGAAGCTCA<br>TTTCGTTGGCCCCTATGAGAACATTGAGTTGACCAAGAGCGTGATCTTCTGGGACCTTCTGAGGAGGACCAG<br>GGAGCAACTCAGCAGCGATAAGTTCACGGAATCAAGAAAAAAGTTCTTTAAGGAGATCTACTTCCCCCTTAA<br>CCTCTACAATGAGGGCAGCCAAGGGCTCGCCGTGCAACCCTACTACCTGAAGATTGATCAGCAATTTGGACT<br>GCTGGTGGATTTTCAATTCAAACTTGACAAAGATTTCACCTTCAGCCGGAAGATTCAACAGCTCAGTCTGAC<br>ATTGGATGGGAAGAACCGGAGGAACCTCAACTACTACGTCGACAGGATAACCAAAACCAACCAATTCATCAA<br>GGCCCTCTGGAACATCATTGGCACCTTCTCCCATAATGAAAACAAGGAAACTACACGCTGAGGAACGACTT<br>CTACCCCTGCGCCGCAAGCAGGCTGCGGTCTCGAATGTATCTCTTTTCCAATGGCAGTGAATCCAGGAGCCA<br>GTTCAATGGCTTGAAGGAATACGGCCCACTCCGACCCCTGACAGCCAATCCGACACTGCTGTTTGTGTTCCG<br>GGAACAAGACCGCGACGCCGCGAGAAAACTGGCGATGGCACTTAAAGGCAGCAAAAGCAAGATCAATACAG<br>CTTCCCCGGGTTCAACTCCCTGTTTAAAGCGGACCTGTTGATCGACGGAAATCCCATGGTCTTGAAAGACTT<br>TTCTATCGAGAGCAGCAGGGAGGTGTTGGCCAGGGTGACAACATCAACATCCAGCTTGTTGCCCATTTTCAT<br>CCTGCCCAACCGCGAGGGCAGCGGCTACCTGGAGCACAAAGCCATCTTCGCCGAGAACGGCATACCTACTCA<br>AGCGTGCACACTCCAAGTCATTCAGGACGACGTGACCCTTAGGTGGAGCGTCCCCAACATCGCCCTGCAAAT<br>ATTCTGCAAAGCGGGTGGCTGGCCCTGGAAAGTGCAGAGCCCCGTAACCGACAACGCCCTGATTATAGGCAT<br>AAGTCAGAGCCACAAGTTGAATTATAGTGACGGTAAGACAACTGTGGACAAGCACTTCGCTTTTAGCGTGCT<br>GACTGATTCAAGCGGCCTCTTTCAGAAAATTCAGGTGCTGAGCGAGCAGAAGACGGAGGAGACCTACTTCGA<br>ACAACTGAAGCTGAATCTCAAAAGCATCCTGAACGCCAATAGCAAGAACTACCAACGCATCGTGATCCACAC |

TABLE 19-continued

Argonaute nucleic acid sequences containing 2 nuclear localization sequences and a cloning sequence

| SEQ ID NO | Argonaute | Sequence |
|---|---|---|
| | | CTCATTTAAGCTCAAATACAAAGAAATAAGTGCAATCGAGGAAGTTGTTAGCGAATTTGCAAGGAACAGCAA CAGCGCCGACTGCAAGTTCGCCGTTGTGAAGGTTAATCACAAGCATAGGTACTTCGGGTTTAATCGGGAAGT GAATAGCTTGGTGCCCTACGAGGGAACCGTGTGTAAGCTGGGCGATAGAGAGTACCTGGTCTGGTTCGAGGG TATCTATCAGGAGAAGCCGACCGTTACCAAAGCATTTCCGGGTCCCACCCACATCGAATTTCTTAAAATCGG GTCTAATAACGTGATTAGCGACGACCTTTTGTTGCAAGACCTGATGAACTTGAGCGGAGCGAACTGGAGAGG CTTTAATGCGAAGAGTGCTCCGGTATCCATCTTTTACTGCCACCTGGTGGCCGACATCGTGCATGATTTCCA AATCAAAGGCCTCCCTATGCCCGCCATAGATCTTATACGACCCTGGTTCATCTAGTAACTCGAGGTTAACTT GT |
| 324 | 11 | GGTGTCGTGAGGATCCATGCCTAAGAAAAAGCGAAAGGTCGAGGATCCAAAGAAGAAACGGAAGGTGGGCAG CGGCTCCATGCAAGAACACCTGAAGACGAACATACTGAACTTTAAATGGCCCAACTCTGCTCCGACCATCTA CCTGACATTGGAGGACATTGAGGGGAGCCACCCTATCCACAAAAGCAAATTTTCTAGACAGATAAAAGAAGT GTTCCCCGACGCGGATTTGAGTAACAAGGACCAGATCTTTACGACATTCACGACCGAAATCCCAGACGCCCC AAGCATAAAACTCTTGAACGTGGACGGCCGAGAATTGCGGATCTATAAACAGTTCCTCAAGCACAAGCTGCG GTCATATTTCAAATCTAAGGACTACATCGTGGTCAAGAATTTCGTGGGCGACGTTCAAGTGTGGATGCCGAG CAAAAAGGGTAACACCGCAGATTACAACCTGTACTATAAGTTTAGCTTTAAGATCCAATTTGCCAAACTGAC GGACCTCCCCGAGCTGATCGTAAGCTACGATGGCACCTCCAAGGTGCTCACGACGTCCGTTAAGGACATCGA AGATTCAGAGCTCATCAAGCGATGCGTCTACGGCCAAAAGACGTTTAACTACCAAATGGACTTGGACACCGA AGAGAAGCAAGAGTTTTACAACGCGATACAGTTTGACCAGGCCTACCCAATTTTCAACCTTTCCCTGGCAAG GGCACTCGACATCCCCATAGAGGAGCCAATAAGGCCGATCAACAAATACCAAAAATACGTAGCCCTGATTAA CAATTTCGCAACTAATTACCTTTTCAAGGAGGACTTCAAGGTTATCTTCCCGTTTAAAACAGACACGTTCAT CGACGTGCCTATAAATCGGATAAATCACATCGACCCCCAAGTCGGCCTGTTGGAATTCGGAAAAGATCAATA TGGCAACAAGAAAACCCACCTGGTACCTAAAAAGGCAATGAACATCTTGAATCCATACCGGCGACCTAATAA TCAGAACATCAAATCTTTTTCATCTGTCACACAAGCCACAAAGACTCCGTGCTCAGCTTCTATCAGAATCT GAAGGAAGGAGTAAACACGGAGAAGAACTACTACAAAGGACTTGAAGCCTACGTGAACATTAAGGCAAGTAG TAGCAAGGAGCATTTTATCGAGTTCACGAACGAGAATGACCCCATCCCGGAGATCGTGGAGAAGCTTGAGAG CCTCACATTTGATCATGACAATGTTCTCTACGCGGCGTTCTATCTCTCCCCCTTCGACAAATTCACCCAGAA TCCGGAGGACCGGGAAATTTACATCCAAATAAAGGAGTTGTTCCTGAACGAAGGTATCGTGACCCAAGTTGT CGATTACGAGAAATGGTCGTCAATATCGAGAATCAGTATAACTTCCAGTTCAGCCTGCAAAACATGGCCCT CGCCATTCATGCTAAGCTGGGCGGTGCCCCGTGGAAGCTGGCCGTGACCGACAAGAAGGAATTGGTCATCGG GGTTGGAGCGTTTACAAATCAAGGCGAGAACAGACGCTATATTGCTTCCGCCTTCTCCTTTCAGAATAACGG CCTCTTCCGCAAGTTCGAGTACTTCGATCAAAGCGAGACCGACCTCCTGGCTGGCAGTATCTGCAAAGCCAT CCGCGACTTCACCAGCGTAGCGGAGGCAGATAAGGTCGTTATCCATTTCTATAAGGAGATGAGTTACGAGGA GCTTAAACCCATCATTCGGGGCATGCACACGCTTGGGCTGAAGATACCCCTTTACATACTTAACATAAACAA GACTGAAGCCGAGGATATTATCGCCTACGACCTGAATTGGAACAAAAAGCTGATGCCCGTCAGCGGCACCTA CATTCGCATCTCCGAAAATCATTTCCTGCTCTTCAATAACGCACGATATCCTAATTCCCAACGGTAGCCGA CACGGATGGTTACCCGTTTCCCATTAAGATTAAGGTCAGCTCTCCGGACGAGGATGCCTTTGAAGATGCAGA TGTGGTCCTGGAGCTGCTTACTCAGGTTTATCAATTTAGTAGACTGTATTGGAAAAGTCTTCGCCAACAAAA TGTACCTATCACCATCAAGTACCCAGAGATGGTAGCCCAGATTGCCCCCCATTTCAACAACGGGGTGCCCGA CGATGCCAAGGATGCTCTGTGGTTCCTGTAGTAACTCGAGGTTAACTTGT |
| 325 | 48 | GGTGTCGTGAGGATCCATGCCCAAGAAGAAGCGGAAGGTGGAAGATCCGAAGAAAAAGAGGAAGGTTGGCAG CGGGAGCATGACTGAGGACTTGTACCTCGACTACGACGCGTTCCTGCGGAGCTTTAAAGAAACATAGATGT GCCGCACTCCTTTCTCCTGGGAGCAGGTACATCCATTAGCAGTGGCATCCAGACCGCCTACGATTGTATCTG GGAGTGGAAAAGGACATTTACCTCTCCAAGAACATCAACGCCGCTGAGTTCTATAAGAACCATAAGGACGA GGCGGTAAGAAAGAGCATCCAAAAGTGGCTGGATAACCAAGGTGAATACCCAGTTCTCGACAGCACGGAGGA GTATTGCTTTTATGCCGAAAAGGCCTATCCCATCCCCGAGGACCGCCGCAAGTATTTTCTGTCTCTTATCGA AAATAAGGAGCCCTACATAGGGTATAAGCTCCTCTGTCTGCTGGCCGAGCGCGACGCAGCATTGTAAAGGCTGTCTG GACTACTAATTTCGATGGCTTGACCGTCAGGGCTGCTCATCAGAACAAGTTGACGCCCATTGAGATAACCCT CGATAACTCTGATAGAATATTTCGCAACCAGTCTACCAAGGAATTGCTCACAATTGCGCTGCATGGTGACTA CAAATTCTCTACGCTGAAAAATACGGAGAAGGAGCTCGACAACCAGAACGACACATTCAAACAGCAGCTGGG GACGTATCACGTGGACAAGAATATGATCGTAATAGGCTACTCAGGGCGCGACAAGAGCCTCATGGACGCCAT CAGCGAGGCCTTCAGTACGCGGGGTGCAGGGAGGCTTTATTGGTGCGGCTATGGCGAGACGATCCCCAACGA GGTTAGCGAGCTCATACTGAAAATCAGGTCCCAGGGTCGCGATGCATACTACATATCAACGGATGGATTTGA CAAAACGCTGATACACCTGTCTAAAAGTGCGTTCGAAGCAACCCCCGAGATTACGAAAAACATCCAACTCGC GCTCGAAAACAGCGCGGACGAAGAGTACTTTAAGACTGACTTTTCACTGAACTTTAGCAAGCCGGATAAGTT CATCAAGTCAAACCTCCACCCCATCGTGTTCCCGAAAGAAATCTTTCAATTCGAGCTTGACTTCAAGGAGGA CAAGCCTTGGCAACTCCTCAAAACTATTTCACGCGAGACAAACATTTGCGCCGTGCCGTTCAAGGGTAAGGT GTTCGCACTGGGCACGCTTACTGACATTGGGAACGTCTTCAAGAACCGCCTGAAGAGTGATATAAAGCGCGA AGCAATTAGCACCTCCGACGTGGATAATGTGAGTGCCTTTAAATCTCTGATGCTGCAGGCTGTGCTGAAGTT TTTCATTGGTATCGAAGGCGTGGAGTCAACCTCAAAGACAGATTGTGGCTTACCAACGCGGAGCGACTCGT GGGTGATATTAGTGTGCATAAGGCTATCCACCTCAGCCTGTACTTCGACAAAAACAAAGGATTCGCTTACCT GTCCTTCACCCCCACCGTACAACTCATCTCTCCTGAGGGAAATCAGCAAAATCAGAAGCAGAGAATCTCTAA GAGTAAACTCGAGAAGCTGTTCAATGACAAGTATGACGAGATATTGGAGTTCTGGAACCAAAAGCTCTTTAA CAATAGCCAAATCAAGTTCGAGTACCCGATCAGCTCAGGTAGTGGGTTTGAGTTCAAAATCTCCGCCAACAC CGCATTTGGGGAGATAAACGTATTGGACCCCAACTTTCGCTCCTTTTCCCCTAGAAATTATGACCCGAAGCG CACACAGTTTAAGGGCGTGCAGTTCCTCGAACCGCAGCTGATATTCCGCAACATCAGTACTAATGTGGAATT TAAGGACTACCACCCGATGAGGGGCTGGTGAACAACCGACCGTTCGACGTGAACCTGAACGGTATAATTCA TTCTAACGAAATAAACCTCACGGTCATCTGCGGCAAGTCATACGCCAACGACGCTGTATGAATTCCTGAGCAA GCTCAAGTGAAGCACGCCACTGAGAATGTCAACCCGGACTATCTTATTGAGTATCCGGGCTTCCAAAGTGT GTTCAACCTGCCACTCAACATACCCCACTTTGACTCTTCCGAGAAGTGGTACGACATCGACTTCGTAGCTGA CAATAACGGGGAGAACCACGAGAATGCCATTAAGCTTGCCAGACTCATCACCACCAAGATCGACCAGATTGC CTCTACACAGAACCAGAGCACGGTCGTGGTGTTTATTCCAAATGAATGGCAGTTGTTTGAGGGGTACCTGAA TCAGGGGGAGAGTTTCGATTTGCACGATTACATCAAGGCATTCAGCGCTAGTAGGGGCATTTCAACGCAGCT |

TABLE 19-continued

Argonaute nucleic acid sequences containing 2 nuclear localization sequences and a cloning sequence

| SEQ ID NO | Argonaute | Sequence |
|---|---|---|
| | | CATCCGCGAGGATACACTGGCGGATACGTTGAAGTGCCAGATCTACTGGTGGCTGAGCCTCTCATTTTACGT<br>TAAAAGCCTGCGAACTCCTTGGATTCTGAATAATCAAGAAAAGAACACGGCCTACGCCGGGATCGGTTATAG<br>CGTGACTAAAATACAGGACCGGACGGAAACGGTGATCGGCTGTTCCCATATTTACGATTCCAACGGCCAGGG<br>GCTCAAGTATCGGTTGAGTAAAATTGACGACTACTTCCTTGACAATCGCAATAATCCATTTCTTAGCTATAA<br>GGATGCGTTCCAATTCGGTGTGTCCATACGGGAATTGTTTTACCAGTCCCTGGACAAATTGCCTGAGCGGGT<br>AGTTATACACAAGCGGACCCGATTTACCGATGATGAGATCAATGGTATTAAGGCGTCTCTGAACAAGGCGGG<br>GATTAAGAAGATTGACCTGGTGGAGATTAACTACGAGACGGACGCCCGCTTCGTGGCCATGTCCGTATACCA<br>GAATGCACTGCAGGTAGACCGATTCCCTATCAGTCGGGGTACTTGTATAGTCACAAATAAGTACACTGCCCT<br>TTTGTGGACGCACGGGATTGTCCCAAGTGTACGGCAGCCAAACTACAAGTTCTACCTTGGCGGTAGAAGCAT<br>ACCGGCTCCGATCAAGATCACAAAGCATTATGGTGATAGTAATATAGACGTTATCGCCACCGAAATCCTTGG<br>GCTGACCAAAATGAACTGGAACTCCCTTGACCTTTATAGCAAACTTCCCTCTACGATCGACTCCAGCAATCA<br>GATCGCTCGGATTGGCAAACTGCTCTCCCGGTACGAAGGCAAGACGTACGACTATCGATTGTTTATCTAGTA<br>ACTCGAGGTTAACTTGT |
| 326 | 31 | GGTGTCGTGAGGATCCATGCCCAAGAAAAAGCGGAAGGTTGAGGACCCAAAAAAGAAGAGGAAAGTTGGCAG<br>CGGGAGCATGGAAAATCTGACCCTGAATATCATCCCTTTCAGCCACCCCGTGCAGGAGCTTGAGATCGGCTT<br>CTATAAGCAAGAGAAACAGGGATGCTACAGCCTGTGGAAGGGCGAGTACCCGCAGTCATTCTGGGACGACTT<br>CAACGAGGAAATGCAAAATTGCGACAAACTCTACACCAACTTCATTGACACGGAAAACTGTGATTACAAAGC<br>CAGTGTGGACTTTAGCAAAAACAGACGCCTGGCGGTCCATTACTACAGCAGGCTGATCTACAACTACTTTGA<br>AACAGTGGCAGATGCCGTGAAAATCAACTTCGTGAAAGATATCCAGATATGGTTCAAGGACGAGACCAAGAG<br>CACCGCCGTCTATACCAGTTACAAGCGGTTCACGATCAAGGTCCAGTTCCATAAGGTGACCGAGTCCCCAGA<br>GCTGTTGATCAGCTTCGATGGCAATACCACGGCCTATAACAAAAGTCTGGCCGAGTTGGACGATTTCCCTCC<br>CGAGCTGATTAACTACGTTAAGTACAATACCCAAGTGGTGAAGTACGAGTTCGCCGAGGACGCTATTAAGCA<br>GCATATCGAGGAGCTGTACCCGATCCTGAGCAACCCCATCAGGGACTACCTTAAGATTGCCAGGCCCGATTT<br>TAAGAGGGGCAACAAGTATAAGCCCTACTACAAGAACATTACAGACTTCTATCACAACCACCTGAACTCCAA<br>AGAGTTTAAAGCTATCCTGCCTATCTCCGAAGACGGTTTCTACAAAATGCCTAAGCACAAGGTTCACAAAAC<br>CAGCTTCAATAGCAATAAACTGAGATTTTTCAATAACACGGACATCGTGCCCCACAACGGGATGAAAAACAT<br>CGGCCCCTATAAGGCGTCCCCCCACCCCAACGTGAGGTTCTTCTTCATCTACCATAAGCCAGACCGAAACTT<br>CGCCGTCAAGACGCTGTACGAATACTTTACGGAAGGGTACAAGAGCCCAGAGGGCTACCTTTACTTCAAGCC<br>TCTCAAAACCTACATTAAACAGCCCTTTCTCATCGACAAGGATACCAGCATCGCGTTCGAAAGCCCGGAAAG<br>CGCTCTGCGCGAAGTCAAGCAGGGTTTGCTTAACCTGGAAAAGCAGCCCAATACGAAATACGTCGCTATCTA<br>TGTGACCCCCATACATAAGACCGAGACCGACGAGCACGAGGAGATGCTTTATTACCAGGTCAAGGAAGAATT<br>GCTCAAGCACGACATATCAAGCCAGGTGATATACAAGGACAACATTGGACATAAGGATTTTAGTTTCTATCT<br>GCCCAACATCGCCATCGCCCTGCTGGCCAAGATCGATGGAATCCCCTGGAGGCTGGACAGAGACACTAAGGA<br>GGAACTTATCGTGGGCGTAGGCGCATTCACAAGCCTGAACCACAATATCAAATATGTAGCTAGCGCCTTCTG<br>CTTTAACAACAATGGGGAATTCAAGGGATTCGAACTGCTTCAAAGCGAATGAAACCGAACTTTTGGCTGGCAC<br>CATCGGCAAGCAAATCCTGAAGTATGTGGTGGACAACGGCGAGAGCGCCAAGCGCCTGATAATCCACTTTTA<br>CAAAAAGATCAGTAACAAGGAACTCGAGCCCATAAAGAAAATGCTGAACAAGCTGAACCTGACCATCCCCGT<br>AGTGATAGTGACTATCAACAAGACGACCTCAGAAGATAACGTGGCGTTTGACACCAGCAGCCATAACCTGAT<br>GCCCGTGAGCGGCACCTACCTCAAAATAGGATGGGACCAGTACCTCCTTTTCAACAACACGAGATACAACGC<br>CAGCGACACCGAGAAGGATAACCCCTTCCCTGTAAAGCTGAGCTTCTCTAGCACCGTAGACAATTACTTCGA<br>CGACAGGAAGGTGGTCGAGGAATTGATCGACCAGGTGTATCAGTTCTCCCGCATGTATTGGAAGAGCGTGAA<br>GCAACAGAACCTGCCCGTTACCATCAAGTACCCCGAGATGGCGGCAGAGATCTTCCCATTTTTTGAAGGCGA<br>TAAGCTGCCCGACTTCGGAAAGAATAACCTTTGGTTTCTGTAGTAACTCGAGGTTAACTTGT |
| 327 | 2 | GGTGTCGTGAGGATCCATGCCGAAGAAAAAGCGCAAGGTAGAAGACCCTAAAAAGAAGCGGAAAGTTGGCAG<br>CGGGTCAATGAACACGCCTTTGACGCATTACGTGCTCACCGAGTGGGAATCCGATACAAATACTAATGTATT<br>GCACATCCACCTGTACACCCTCCCCGTTAGGAACGTGTTCGAGCAGCACAAGGAGAACGGGTAACGCATGTTT<br>CGATCTTCGCAAGCTGAATAGGAGTCTGATCATCGACTTCTACGACCAATATATCGTGAGCTGGCAGCCTAT<br>AGAAAACTGGGGCGAGTACACCTTCACCCAGCACGAATACCGCAGTATAAACCCAACAATACTGGCCGAGAG<br>GGCCATCCTCGAACGACTCCTCTTGCGGACAATCGAAAGCGTCCAGCCCAAGAAGGAGATCGCAGCTGGTTC<br>CCGCAAGTTTACCTGGCTGAAGGCAGAGAAGGTCGTGGAGAACATTAGCATCCACAGGGTAATCCAGTGCGA<br>CGTAACCGTGGACTACGCCGGCAAGATCTCTGTGGGCTTTGACCTCAATCACAGCTATAGGACAAATGAGAG<br>CGTGTACGACCTCATGAAGTCTAACGCCATCTTTAAGGGAGACCGCGTGATAGACATTTACAATAACCTGCA<br>CTACGAGTTTGTAGAGATTTCCAACTCCACAATAAATGACTCCATCCCCGAGCTCAACCAAAGTGTCGTCAA<br>CTACTTTACGAAGGAGCGAAAGCAAGCATGGAAAGTTGGATAAGCTGGAACAGAGCATGCCAGTCGTGTACCT<br>CAAGGCATTCAACGGCAGTAGGATTGCATACGCGCCTGCGATGCTCCAAAAAGAGCTGACCTTTGAGAGTCT<br>CCCGACCAACGTAGTACGGCAGACGTCAGAAATATTCAAGCAAAATGCCAATCAGAAAATCAAGACCTTGCT<br>GGATGAAATCCAAAAGATTCTTGCCCGCACCGACAAGATCAAATTCAACAAGCAGAAGCTGTTGGTTCAGCA<br>GGCCGGCTACGAGATACTTGAACTGTCCAACCCAAACCTCCAGTTTGGGAAGAACGTTACTCAGACGCAACT<br>GAAGTATGGACTGGATAAAGGCGGAGTTGTGGCCTCCAAGGCCGCTGACATCAATCTTCTGGTCTACCCGGA<br>ACTTATAGACACCAAGCTCGATGTGATCAACGATTTCAATGACAAACTGAACGCTTTGTCCCACAAATGGGG<br>CGTGCCCCTGAGTATCCTGAAGAAGTCTGGAGCGTACCGCAACAGACCCATTGATTTCACTAACCCCCACCA<br>GCTCGCGATTCTGTTGAAGGAACTGACCAAGAACCTTTTCCAGGAACTCACGCTTGTGATAATACCGGAAAA<br>GATCAGCGGCATGTGGTACGATCTGGTTAAAAAGGAATTTGGCGGCAATAGCAGTGTTCCGACGCAATTTAT<br>CACCATCGAGACACTTCAGAAGGCAAACGACTATATTCTGGGGAACCTGCTCCTTGGCCTCTATAGCAAGTC<br>CGGCATCCAACCATGGATTCTTAATAGCCCCCTTAGCTCCGACTGCTTCATCGGTCTGGACGTATCACATGA<br>GGCGGGTCGCCACAGCACCGGGATAGTCCAAGTCGTAGGAAAGGACGGGCGCGTGTTGTCATCCAAGGCGAA<br>TACGAGCAATGAAGCCGGCGAGAAGATCCGCCACGAGACCATGTGCCAAATAGTGTATAGCGCCATCGACCA<br>GTACCAGCAACACTACAACGAGAGGCCTAAGCACGTGACCTTCCACCGCGACGGTTTTTGCAGGGAGGACCT<br>GCTGTCACTCGACGAGGTGATGAACTCCCTGGATGTCCAGTACGACATGGTGGAGATCATCAAAAAAACCAA<br>TCGGCGAATGGCACTGACCGTCGGCAAACAAGGATGGGAAACCAAGCCAGGACTGTGCTACCTGAAGGACGA<br>GAGCGCCTATCTGATCGCCACCAATCCGCACCCGAGGGTGGGCACCGCGCAACCCATCAAGATTATCAAGAA<br>GAAGGGGAGCCTCCCTATCGAGGCCATTATACAGGACATCTACCACCTGAGCTTCATGCATATCGGCTCACT |

TABLE 19-continued

Argonaute nucleic acid sequences containing 2 nuclear localization sequences and a cloning sequence

| SEQ ID NO | Argonaute | Sequence |
|---|---|---|
| | | GCTTAAGTGCCGACTCCCCATCACAACTTATTACGCCGATCTGTCTAGCACCTTCTTTAACCGCCAATGGCT<br>TCCGATCGATAGTGGCGAGGCCCTTCACTTCGTGTAGTAACTCGAGGTTAACTTGT |
| 328 | 35 | GGTGTCGTGAGGATCCATGCCTAAGAAGAAGCGCAAAGTCGAAGACCCCAAGAAAAAGCGAAAGGTGGGCTC<br>TGGCAGTATGATTAACAAACTGCAATTCGACGAGTTTCAGAGGGCCATAGGTATTTCTAAGAACGACACCTT<br>CAGTCTTTTGCTCGGAGCGGGTTGCAGCATCAATAGTGACATCCCTAGCGCGGAAGACTGTATATGGGAGTG<br>GAAGCGAGATATTTACAAAACAAATAACAGTTCTAGCTTCGGCTGGATTGACAATTACAAGAATCCCAAGAC<br>TCAGGAGATCATTCAGAACTGGCTCAACAACCAAGGCATCTATCCCGAACGCGGCTGCAAAGAGGAGTACAG<br>CTTTTTACGCCTACAAATGCTATCCCATCGACGAACATAGGCGACAGTATTTTCAGAAAATCTGTAGTGGTAA<br>AAAGCCATCCATCGGGTACAAACTTATTCCCCTGCTTGCCCGAAAGGGCATGCTTGATAGCGTGTGGACCAC<br>GAATTTGGACGACCTCGTGGTGACCGCCTGTATAGGCAACGGGATCCAGGCGATCGAAATCACGCTCGACTC<br>CGTGCAAAGGTTGAACAACCGGCCTCAGAACCGACATGAGCTTCCTGTGATCAAACTCCACGGAGATTTTAA<br>GTATGGCGATCTTAAAAACACCGAGGAGGAACTCCTCAATCAGGATAAAACGTTCAGGGAGAGACTTATTGA<br>ATACGTACAAGACAAGCACCTGATCGTGCTCGGCTACAGTGGCCGAGACACCAGCCTGATGGACACACTTAA<br>AGAGGCCTACTCAAAACAGGGGGGTGGAATTCTGTACTGGTGTGGATATGGTGACAACATAAACTCCGACAT<br>CGCCGAACTGATTCAAATAGCCACTAAAAATGGCCGACGAGCCTTTTACATCCCCACTGATGGTTTCGATTC<br>TACGCTCCGGAAAATCACACAGATAGTGGTCGAGGATGATAACAACCTGAAAAAGAGCTTCTCGAGCTTCA<br>CCAGACCAGCAATATCAATGACACTATCACACCTTTTGATCTGAAGTGCGAGAGGGTGAATAAGCTGTTGAA<br>GTCAAACATATTCCGGATTAGCTTTCCAGACGAAGTGTTCGTTTTCGATGTGAGCATCAGCGATAAACCCTG<br>GAAGTTCGTGGACGAAAGGACTCTTGAGCGCAACGATATTAGCGCCGTTCCCTATAACAAGCAAATCTGGGC<br>ATTCGGTAGGCTTGACATCATAAAAGACATCTTCAAAGACGTGATGAACTCAGACATTCAGCGAAAACCCCT<br>GGCAAACATCAAGATATACAACACGGCGGTTAGTCGGCTGTTGCTTACTACGATTTGCAAGATACTGGCGCT<br>GCAGAGCAACCTTAAGACCGACTATAAGGGTAAGATATGGACCGGAGAAGACCATTAAGTCCATTTCCGGCCA<br>CATAGTATACAATGCCGTGCTGCTGTCCTTTGATCGGATAAGCGGTGAGTATTACCTTAGCCTCAACCCCGA<br>CTTCGTGCTGGCTAACCCCAACATTGAGAAGAGTAGCATACAGACCATAGGACTGTTCTTCTTCAGAAGCT<br>GTGGAATCAGCAGTTTAACGAGTACATTAACTATTGGAGGGAAATTTTGTTGAAAAAGAATAATGAGTACGA<br>GTTCCCCATAAATAGCGGAACCGGCTTCAAGTTCAAGATCAAGAACATCCCAGTGTTCACTAACATCTGCGA<br>CCTGAATAACCCTCGCATCAACAATCACAACGTGTCCAGCCACCACCTGCTGCTTCAGGGGGTGCAATTTAA<br>GGAAATCCCGCTGCTTTTCAGCACCAACAATGGCAACCGCACGGCCACCGACACCCACCCTATGAGAGGACT<br>TCTCATAAACAAACCGTATGAAACGGGCGTCAACGACTTCCTCGAAAAGTCTATCACCCTGGGAATCATAAG<br>CCCCAGTCAGGACGCCCTCAGGTTCTACCAATTCCTGGAAAACCAGAACTCTAAAATCAAAAAGCACAACGA<br>CAAGGACAACTACATAATAGACTACGAAGGGTTTTTCGCCATCTACGGCGTTAGTCTCAGCTTCCCAACACC<br>TAACGACAACGAGTGGGAAAGGATCAACGAACCGCTGATTATGGGCATCAAGGAGACCGCCCAACAGATAAA<br>GCAACTGATATGCGACAGCATCGTGAAGATCTCAAGCACGACCAGGAGAAAAATCATCGTCATCTATATCCC<br>CCAACGCTGGGAGCCCTACACCTCTTACCAGCTCGATGGTGAGTCATTTGACCTCCATGACTACGTGAAAGC<br>GTTCTGCGCGGAGAAAGGGATTATGAGCCAACTCATTCGAGAGAAGACCATTAACGATACTATCCAAAAATG<br>CCAGATACATTGGTGGTTGTCTCTGTCATTTTTCGTAAAATCCTTCCGGACCCCATGGATTCTCGCAAATAC<br>TAACAACACCACCGCCTTCGCGGGTTTGGGGTACAGTGTAGAAAACAAGAAGGATATTAACGGACATATTGT<br>GCTGGGGTGTAGCCACATTTACAGCTCAAACGGAGAAGGGCTCAAATACAAGCTGGCCAAAATAAGTAATGA<br>TAAGATTCAGTGGAGGCATAAGAAGCCGCACCTCTGCTACGACGACGCGTATGAGTTTGGCAAGTCAATTGT<br>GAACCTGTTCTACGAATCTATGAACGAACTGCCAAAAAGGGTGGTCATCCACAAGAGGACCTTCTATACCGA<br>TGAAGAGAAACAAGGGATCATAGACTCCATTAGCGACAATAAGAAAATAGAGAGCATCGACCTCATCGAGAT<br>CAACTTTGAAAACAATATAAAGTACGCCTCTAGCAAAATCCACGACGGAAAGGTAGACATTGACGGATTTAG<br>CGTATCTAGGGGAACCTGCATACAACTCAGCTCTAAGGAGGCGCTCCTGTGGGCGCATGGAGTGATTCCTAG<br>CGTCATTAACCCTAACTGGAACTTCTACCCTGGCGGCAGGTACATACCTAAACCACTTAGGATCATTAAACA<br>TTACGGTACAGGTAGCTTGAACAGATCGCGAACGAGATTCTGGGCCTGACTAAAATGAATTGGAATAGCCT<br>GAACATGTACAGCCAATTGCCTGCCACAATTTCAAGCTCCAATGATATAGCTAGGATAGGTAAATTGATAGG<br>GGCGAACAGTATGCACGAATACGACTACCGATACTTCATCTAGTAACTCGAGGTTAACTTGT |
| 329 | 9 | GGTGTCGTGAGGATCCATGCCGAAGAAGAAACGAAAGGTTGAGGACCCCAAAAAGAAAGGAAGGTGGGGAG<br>CGGCAGCATGAATAACATACCCATCAGGCTGAACTTTTTCGCCCTGAAGAACCAGAACATTAGCTTCAGGAT<br>CTACAGGCAGGACTTCAACGGCCAGAAAAAACAGGACGGGTACTACAGGACCAAGCTGCCCATCAACGACTC<br>TTCTGACACCTACGCGGAGTACTGGGTGACAACCCAGCCCAAGGATGGCTTCGAGAGGGTGTACTGCCTGGG<br>TTCCTCAAACCCTAAGCTCACCGTCCGAATCATGTGGGAGAGCTTCCTGGATAGGGTCCAGAAGTCCCTGAG<br>CTCCGACGAATATATCCTTTACGGTAACGGATTTAGCCGGAAGGTCGCCGTGATCATCGGCAGGCACAGGGA<br>GGGCAATGAGGTGATCCAGATAGAGCCCTATTACCTGAAGGCCGAGAAGAAGTTCGGCTTTCTGGTGGACTT<br>CGCATTTAAGAAGGCCAAGGACGTGCCCTATAGCATCAGGGTTCAGCAGCTGAGCCTGTCACTGAACAAGTA<br>TGGGAAGAGCAACGCCGACTACTATAGCGACAAGCTGGATAAGATAAAGTTCTTTATGCAGAAGTTTAAGCA<br>GAGGCTTTTCCCATTTAGCTTGGATAACGAGGATTACGACATCGAGAACGAGCTGTATCTGATGAGGAGCTA<br>CCCGCTCAAGATGAAGACCTACATATTCTCTAATGGCAAGGAAAGCAACAGCCAGGTGCAGGGTCTCAAAAC<br>CTACGGACCGCTGGCGAATCTCGATAAGGAGCCACTGTTCGTGTTCATGTTCGAGTCCCAGACAGGAACGA<br>GGCCCTGGAGCTCTATTCTAGCCTGCTGGGCAAGACGTACACCAACATATTTGCTGGCATGGAGAGCGTGTA<br>CAAAATCAAACTCGCAAAAGAGAATGTGAAGCACATCATCATCCCCAGCCTTACCAAGGAGGGTCTGCAAGT<br>GGTGGAGCAAGAGCTGCAAACTATCGTGGAGAGTCATCAGGACAAGAAGGTGATTGGGATATTGTAATGAA<br>TGAAAAGGTGCCCTCATCCATCACCGGTTTCAGCCCCTACCCATACGTCAAGTACATCTTCACAGAGAAACG<br>CATTCCCCTCCAGACAGTGAGGTGCGAGAGGATCGCTGCCAGGGATGGCCTCAAATGGAGCGTTGGCAACAT<br>CGGCCTCCAAATTTTCGCTAAATTGGGCGGCATCCCCTGGAAAGTCAAGCCGAGTAACGATAAGTGCATCAT<br>TTTTGGCCTGGGCTGCGCCCACAAAAAAGACGAACTGGGAAACATTAACAAATACTTCGCCTACAGCGTGTG<br>CATGGACGACAGCGGCCATTTACCGAAAGATTAATGTGCTCGGCGATGCAAAGGAGCGCACTATTACATCCT<br>TCAACTGCGGGAGAACATCAAAAGCGTGATAAGCGAGAATCTGGACGGGAGCATTGAAAAGTGCGTGATTCA<br>CCTGCCCTTCAAAATTAAGAACGACGAGATCAGGTACATAAAATCCAGCGTGCAGGAGATCGCGCACCTGTA<br>TTCCGACATAGAATTTCAATTTATCAAGATCAACACGGACAACAAGTTTTTCGGATACGCTGAAAACAACAG<br>CAAGGTACCCTACGAGAGCAGCTACATACAACTGAGCAGCAACGAGTTCCTGGTGTGGTTCGAAGGCCTGCA<br>GTACGGGAAGGAGCTGGTGAAGAAAAAGGTAGGTAACCCCGTGCACATTGAGTTCATGCAGATCGATGAGTT |

TABLE 19-continued

Argonaute nucleic acid sequences containing 2 nuclear localization sequences and a cloning sequence

| SEQ ID NO | Argonaute | Sequence |
|---|---|---|
| | | GGATCCCGAAAAGAAGCGGCGATATCTGCAGGATATCATAAACCTGAGCGGTGCCAACTGGCGAGGTTTTAA CGCCAAACTGTCTCCAATCAGCATCTACTACCCCAACATCATAGCCAATTTCATTTCAGAGTTCAGGGAGTT CCAGCCCGAAGGCGACGTGGACCTGACCAACTTTTACATTCCCTGGTTCCTGTAGTAACTCGAGGTTAACTT GT |
| 330 | 10 | GGTGTCGTGAGGATCCATGCCCAAGAAGAAGCGCAAAGTAGAGGACCCTAAGAAAAAACGCAAGGTCGGCAG TGGCAGCATGCATAACATCGAAATCAACACCTTCGTCAACAGCTTTGCCATTAAACCCAACAACTCCATGTC CTTCCTGCTCGGCGCAGGCGCGTCTATATCCTCCGGGATCCTGTCTGGCGGACAGATGGTGTGGGACTTTAA ACGGAACCTCTATTGTGCGTCCAAAAACATACGCACCAGCAATTTTCCCGATATGAGCAAAAAGAATGCGCA GGACGAGATCCAACGCTTTTTTGATGGGCAGGCCGGAAATCCTAGCCTGTGGTCCTCCGAGGAGTATAGTTT CTACTTCGAGAGGTGTTATCCGGCGAGGAAAGACAGGGAGCTGTACATACAGAACAAGGTACGAGACGTCAA GCCGTCATTGGGGTATCTCTGCCTCGGGGAATTGATCATACACGAGAAGATCGGTGTAGTATCAACCACAAA CTTTGATGACCTGGTGTTGGCCGGCATCCATTCAATAAGACCGGACCTGAGTGTGAAGACCATCAGCAGTGC CCTCAAAAATAGCACGGGATTCTTCGTGAACGACGGGTTCCCGAACATCATTAAGCTGCACGGCGATTACTT GTACGATAAGCTGAAGAATACCGATAAGGAGCTGCAAAAGCTCGAGACGGAGATCAGCGGAATTTTTCGAGA TGCCGTCAAGAGTGGCGGGCTCATCGTACTTGGCTACGCCGGCAACGACAACAGCGTGATGAGCGTCCTGGA GGAGCTCGTAAGCTCCGGGCAAATCAGGTACGGCGTGTTCTGGTGCCAACCGAAGGGCTTCCCCCTGTCCAA GCGAGCGCGGGAGTTTATTGAGAAGGCTTGCGCCTACAATGAGGAATCCGGGGTTGTCGAGATCAACAATTT TGACGACTTTATGTACCGCCTGTTCCTTACACTCAACATCCAAAACTCATTTATCGACAGCATGTGGGAACA GAGCGGCATGAAGCAGCCGATCCTCTATGAGAATATCGGACGACACAAGTCCACCGCCGTGACGAACGCCCT GTGCGCCCTGCAGTACCCCGAAAATGCTACGTCTTCAACGCGAATATATCAAGCTGGAAGGAACTGCGCGA GACGATAAACGACACGTGCGTGGCAGTGCTGTATAAGGGCATGGTTTGGGCGCTGGGCAGCAAAGCAGGCAT CGTGCATGCGTTCGCCGGGAAGATCAATGGAGACATATACGAACTCGACATCCCGTTGTACATGATGAAACT CGAGGATTCTGACATCCTGGGCATGTTTTACGACATCATAGGACGCGGCCTTCAGCGAAAGGGGCTGGTGAG CTACGGTAATAGGAAACATCACAAATACTTCAACCCCTCCAGCAAACGGTTCAAGAACGGTCAAAACATCTA CGACGCGGTCAAGATATCACTGAGTTTCGTGGACGATCAGCTCGTGCTCATCCTGCTGCCTACGGTGCATCT GCTGAAACGCCGACGGGACGGACTGGAGAAATTTGACTACCAAAAATTGGTGTCCCAGGAGATGGCAACACA CTACAACAAAGTGGTGGACAGCGAGATAGAGATCTGGCTGAAATTCATCTCTAATAACGGCAAGATAATCTT TGAGCTGGGGAACGCAATACTGGAATTTAACAACGTCCGCATCCAGTACTCTGGTAACGGTAACCTCAGCAA GTGCTACCAGGTGAGCGAGCCCGAGCTCACGTTCAGTTACGAAAAGGACAACTGCATCGCTACCAACCAACT GCGGGGTCTGATCAACTATGGACCCCATAGAGACTTACGTGAACAAAGCCATCAGGTTGGCTGTACTCAGCCC TAAGGAGTGTGCCGCGGACATTTGGAAACACCTGCAGAAGTTGAATGAGCATCACGTCCACCTCCCTTATTCA GGATGCAAATTTTCTGCCGGAGTACACCGGCTTTCAGAACGTTTTTAGGTGCAACCTTGACATTCCCAATGG GAACGATGTGCATAGGTTCAAAGGCTACAGTATAGACAAGGTCATGCAACTCAACGCAAAGAGCTACTTTTA CGGGATCTGCAAGTACATTGATGCATTCGAGACACAAAGGAGCCAATACGACCTCCTCGTCATCTATATACC TAAGCAGTTGACCCACATCCGAGAGGCCAAGAATAACTTCGAATATTTCGACCTGCACGACAGCCTGAAGAT TTATTGCGCTGGTAAAGGTATAGTCACGCAGATCATCGAGGAACACAGTGTTTATAACAATGACACCGC CAAGATCATATGGGGTCTCTCAACGGCCATATTCACCAAGACCGCCGGAAGGTTGTGGAAACCCAGACGCTA TTCCATGAACACCGCTTACGTCGGCCTGTCATATGTGCAGAGCGTTAAGAACAACGAGAAAGTCAGCATCGG TTGCAGTCAGCTGTTCGACGCCGAAGGCAATGGAATGAACGCTTTACCTGAGACCCTTGATGAACCCCCAGAT AATTCAAAATAACCCTTTTATGCGGAGCGACGACGCTTGCAGGCTTATGTCAAACCTTAAGCGGATGTATGA CGACAGTGTCCCGCTCTACAAACTGAATAGGATCGTGATCCACAAAACTACGTTCTTCACTAAAGAAGAGAT GGAAGGCATCACCAAAGGGCTGGCTGGAGTGGATGACATAGAGTTGCTCCAGATCCAGGAGTTCACAGCTTG GCGAGCAATACGCTTCGACTACGACAAGATCGCACCGTTTCCGATACAGAGGGGCACAGTGATTCTGGGGTG GGGCCACTTTAGTTACTTGGATACCTGGAAGTGTACCACCTAGTAACTCGAGGTTAACTTGT |
| 331 | 7 | GGTGTCGTGAGGATCCATGCCTAAGAAGAAGCGAAAGTGGAAGACCCAAAAAGAAAAGGAAGGTGGGTAG CGGCAGCATGAACGCCGTGACCGTGGGCAGCACCCCAAGCGCCCAGGTACTCGTCGGTGTTCAGCCATACGA CGAAACCACCCTGGAGAGCCTGAGAAGTAAACACCGCGGAGACTATCTCTTTAAAAGGGGGGAGAGAACGG CGATAGCATACTTGCTGTGGCCCTGAAACCGAGTCTGCCGGTCATCGGAGCAACCGAGGAGGATGTAATTCT TGCCGAGAGCCCATGGTTGTTGGCTCCACTTGCCTTGGAGACTTTGCTGCAATGCTTCGTGAGGCTTCAAAG GCCCATCCTGAAAGCTAGGCATCCCCTGAGAGTGCTCTCACAAAAACCGGCAAATCTTTTCCCAGCCGATGC GGGGGTCCCCCAGTGGCTGCAGAGGAGACTGGTGCTGGAATTCGACACGCGCACTGTTAGGGACAGGTCAGA CGCTGCCTCTGTCGTGCTGGCATGTGGCGTGAGGACTCGGAATTTGATTGATGCCGACTGCGCGACACTGAT AGCAGCCGGTGTCCCCCTTGTGAATCGATACGTGGTGACGAGGCACCCTGCGGATGATCCCCGAGTGCAGGG CTATTTGAGGCTCGCCGGGAGGGTGACCAGGATAGATGGCCCCAACCTGTACTTGGAGGATCATGGCGATGG AGCAGCTGTGATCAAGGCCTCCATGGCCTATCTGGAGCCCAGGAGGGAGAACGTGATTTGGTGTGCCCACCA TTTGCTGGGGAGAAATGCGGATAGAGTACTGGCGGAAGCGGATAACGCAGCCGCAAAGCACTTGAGCGGTCC CGAACGATTGGCCGTAGTGAAGAAGACTTTCGACTACCTTAGGAGCCAGAACATCGAGCTTGCGCCTGGAGT GCCCCTCACTCTGGGTAACGTTGTGGGGAATGACAAGGGTTCTTGGATCTTCCGGACGGAAACTCTGCCCAA GCCCCACCTGGTGTTCGACCCGAGCGGGACCCGGATTGCAGGTAGGTGGAATGAGAGGGGATTTGGTGCGCTCACG GCCCTATGATCAAAGGACCTTCACCCCTAAACAACTGAGGATTGCCGTCATATGTCAACTGCCCTACGAAGG CCAGGTCGATGCGTTCCTGGCAAAATTTCTCGACGGCCTTCCAGACGTGAAGACCGGCTACGGGGACCGGGC CAGGGCGCCTTATGCCAAGGGGTTCATCAGGAGGTACGGTCTGGAGAAGCCCAAGGTGAGCACCTTCGCAAC AAAAGGCGCTACTGCTAAGGACTATGCCGCTGCATGTAGGGCGCGTGTGGAGGACGCAACCGCAAGCGGCTT CGAGTGGAATCTGGCTATCGTGCAGATCGACAAGGATTTCAAGGAGCTGAGTGACGTGGAGAATCCCTACTT CACCACCAAGGCCCTGCTGCTGAAGCATCGGGTGCCCGTCCAAGAGGTGACGCTGGAGACGATGAGGTTGGC AGACGAACAGCTGGTGTACGTGTTGAACAACATGAGCGTAGCCACCTACGCCAAAGTGGGCGGTACTCCCTG GCTCTTGAAAGCGCAACCAACCGTGGCCCATGAGTTGGTAGTTGGAATCGGAAGCCAGACTTTTAGTGCCTC AAGGCTGGGTGAGAAAGAGAGGGTTGTAGGCCTTACCACCGTGTTCTCCTCCGACGGGAATACCTGCTGGA CGACCGGACTAGCGCCGTTGATTACGACAACTATAGCGAAGAGCTGTTTAAGAGCTTGTCCCGGTCAATAGA ATCAGTAAGGATCGCCGATAACTGGCGAAGTACGGACAGTGTCAGGCTGATTTCCATGTTTTCAAGCAGAT GGCGGACGAGGAAGCCGACGCGGTTGACAAGTTGGTGCAAAAGCTGGGTTTGGCACAGGTTAAGTTCGCGTT TCTGCACATCGTGGATGACCACCCATTCGCCCTGTTTGACGAGAAGAACATAGGTACAAAGACATGGGGTGG |

TABLE 19-continued

Argonaute nucleic acid sequences containing 2 nuclear localization sequences and a cloning sequence

| SEQ ID NO | Argonaute | Sequence |
|---|---|---|
| | | GATATTCAAGGGCGTCTTGGCACCGGAAAGGGGCCTCGCGGTAAACCTCTCTGGGGCCGAAACCCTGTTGTG CTTCACAGGCGGCAGGGAACTGAAACAGGCGAAGGATGGCCTGCCCGTGCCTAGTCTGCTGCGACTGCACCA CAGGAGTACGTTCAGGGACATGACCTACCTGACGGGGCAAGCCTTCAACTTCAGCTGTCACACCTGGCGCAT GTTCACACCCGCTCCTGTTCCCATCACAATACATTACAGCGAGCTGATGGCGCGACTCCTTACGGGCCTCAG GCACGTCCCGGATTGGGATCCAGACACAATGCTGACCCCCATCAGTCGAACCCGGTGGTTCCTGTAGTAACT CGAGGTTAACTTGT |
| 332 | 13 | GGTGTCGTGAGGATCCATGCCCAAGAAGAAGCGAAAGGTAGAGGACCCAAAGAAAAAAGGAAGGTGGGCTC CGGATCTCTGGACAGTTTCCACCTCGTGCAGACAGAGAAAAAGGCCATCGCAATGCCAAAGCAGAAGCTTGC GGTTAATGCACTCCCCATTAGCCTGAAAGAGCAGGAGCAGCACAAGCTGTTCTTTTTTAGCAAGGAAAAGCA GGGCGAGCGAGCCCCGCTCACCAGGAAAGAATATCCTGACAGCTTCGCCAAGAGGTACCCCAAGAGCTCCAA AGAGTACGACGTGCTGTACACGGACTTCACCCCAGAGCCAGCTGAGGATGGGTTTGAAATTGATATCGACCT GGAGGAGGCACCTGGCCTTGCCAAGCACTACTTGCACAAAAGGATCTTTGAGGCCTTTAAGGGAGTAGCTGA CTTCAGAAAGCGGGATTTCATCAACGGTGTGGAGCTTTGGTTCAGGGACAAACCCGCCGACGAAGTTAATTT CCGGGCCTACAAGAAGTTTAAGATTACCACCCGCAGAACTTGGTTCTCCGCAGGCTGGGCCCTGTTCATACA ATACACCGGCCATTCCTTTATTCACCCGGTGGCGATCAATAGCGAAGAGGCCGCAGTGGACACTACGGAACT CACGCGGGTTGCTTATAACCGACACATCTTCCACTACGAGGAGATCCCCGAAGACAAACTGAGTGAGATAGA TTTCAGTAAGATGTACCCCGTGGTGAACTTCAACATTAGGGATAAAATGCAGCAGTTCCCCGTTATCGATCC ATTCAAAAACAAGGTCAAGGAATATGTCGACGAAATAGCACAGGTTCAAGAACATGTATCTGATCGCGCCAGC GGGTTGAGGAGGTGCTTCCGTTTACTTTCAACGACGACAACTGGTGCGAGATCAAGATCGGCACCTACCATAC CGTGCCCAATGCCGGTTCCAAATTGGTTTTCCGCGATGGGCAAACCGAGATACACCCGTTCTACGGTATCAG GAACCACGGCCCTTTCATGCCCCCCAAACACAGCCACATAAGGTTTTTGTTTATCATGAGCAAGAGGGACAT CAAGGGCGCTGGTAAGCAATTCTATGAATACTTGAAGGGGGAGGTAAAAGGAGTGGACGGGTTCAACAGGTA TGCTAATATACCGTCATCCCTGAGGGGTGAGATGATCGAGTTTGAGAACGAGCAAAACCCCCTGCCGGAGAT TATCGACGGCTTGAACAACATGGAGCGAGAAGCGGGCGTGGCCTACTTCGCCTTCTATATCAGCCCCATCGA CCGAGAAGTGAGGAACAGGAAGGAGAGGTTGGTGTACTACAGGGTTAAGGAGGAGCTGCTGAAGAGAAAGAT TGCCTCACAAGTGGTAGAAAGGAGCACTATCGAGAAGGCCGACTTCCGCTACAGCATCCCCAACATCGCCGT TGCCACAGTGGCCAAGCTGGGAGGCATCCCGTGGAAGCTTACTCAACCCCCAGAAGCAGAGCTGATCGTGGG CATAGGCGCATTCCAGCCACGCGAGTTCGACAAGCGATATCTGGGCAGCGCCTTTTGCTTCCAAGGCGACGG AACCTTTAGCGGCCTGAGGTGTTTCACCAAGGACGAACCCCATATGCTTGCTGGCAGCATCAGGGAAGCGGT TCAAAGGTACGCCGATGAAAACAGGCAAGTGGAACGGCTGGTTATCCATTTCTACAAAACCATGAGCTATGA CGAGAGGAAGCCGATCCTGGCCACCTTGAAAGAACTCGGCCTGGACATTCCCGTTGTGGTGGTCACTATCAA CAAGACTGAATACGAGCAGACAATCCTCTTTGACCTGAATTCTAGCATGAGGCTGCCGCTGAGTGGTACCTA TTTCAGCCAGCGCAGGGACGACATCCTGCTGAGCAACAACACCAGGTACCGCAAAGACAGCGAGGTGAAGAG GGGTTTCCCTTTTCCCGTGAGACTGCAGCTGTGGTGCTCCAAGGAGGGCCTGCTGGACGACGAGGGTTTTAG GGAGCGACTGATCACCCAAGTGTATAGGTTTTCTCGGCTTTACTGGAAGAGCGTGTCTCAACAGAATCTGCC CGTGACCATTAAGTATCCCGAGATGCTGGCCGAAAAGTTCCCATACTTTAACTCAAGGAGCCTTCCTAGCTT CGGCGAAAAAAGCCTGTGGTTCTTGTAGTAACTCGAGGTTAACTTGT |
| 333 | 3 | GGTGTCGTGAGGATCCATGCCGAAAAAGAAGCGGAAAGTTGAGGACCCCAAGAAAAAGCGCAAGGTGGGCAG CGGCTCCATGCTTATCTGGCAATTCAAGAGAATGCTCTACTGCCAGGCCAACAACATCAAAGAGGAAAAATT CAAAGACCTGGAGAGCGAGCGAAATCAAAACACTATCCAGAGCTATTTTGACCTGAAGGGCGGCTATCCGGA AAGATATAGCCAGGAGGAATACTCCGCTTATTTCGAGCATTGCTTCCCGAAGTCTATCAACCGGAAGTATTT CATGCAGAAAATAGTAGAGGGCGAAATCCGAGCATAGGTCACAAGTGTTTGGGTGCCCTGTTCGACTGCAA AAAGGTAAACCACATCTGGACAACCAACTTCGACGAGCTCATCGAGAATGGGATTAAAAGCGTCAACAATGC CAGCAGCTTCGAGGTCATTAGTATCGACAATCAGAGGCAGCTGGCCAACCTCAACAACTACCCAAGGGTGGT AAAACTTCACGGCGACTACAGGTACGACAAGCTCCAAAATACCGTTGACGAACTGCAGACGCTGGAGAAGGA CCTCCATAAGTACTTCGCCGATGTGCAAAGCAAGACCGGCTTGATTGTGATAGGCTACGGCGGAAACGACCA GAGCATCATGTCCGCCTTTGAAAAGACTTTGGAGGCCGACAACCCGTTCCCGTTTGGGCTTTACTGGTGCGT GAGGACGGGCCAGAAAACCAACAAGAAGGTAATCGAATTCATAGAGAAGGTTCACCAGAAGAACAAGGAAAA GCTTGCTGCGTTCATCGAAATCGACTCTTTTGACGATTTTCTTTATGAGCTGTATAAGACGAACAACCTTGC CAACGATCACATTGAAAATATCGCCAAAAGCCGCTTCGAAAAAAGGAAGGCTTTTACAGCCCCCCAGATCGG CACCTCCTTTACGCCTATAAAGCTTAACGCCATAAAGGCCAAGACTTACCCGAAAAGCATCTATTCCTTTAA AACTGACCTCAAGGGGGGCAAGGATGACTGGGATAAACTCAGGGAAATCATTAAGGACCAACCGGTGAGCGC GGCTCTGACCAATGAAAACACGGTCGCCTTCGCAAGTGTCAACGACATCAAGAAACTCTTCTCACACACACT GAAGTCAGAGATCACCACCGTGGACATAGATGACAAGTTGATCTATCGGCAGGAGTCTTTCTACCTGGGCAT GCTTTACGATCTGATAGAGCACCTCCTGAAGAAGTTCAAGTTGGAGAAAGTGCCCAACAATAGGCTCCG CAAGTATTATAGCAAAAACTACAAGCTGAATACCGAGGAGCTTCAGAAGTCCAAGATCAAGACCAGCCTGTC CGTCTACGAAGCGTTCGAGATTCAAATAGAATTCACAATAAAGAGCTGTTCCTCATTATCCTTCCGTCCAT CCACATAGACGACAAAGCCGGGCTGAGCCGATTTGAGAAACAGGAGATAGCCAATAAGATCATAAGCAAAG GTGGAACCGCATGGTTAACAACCAGCTTAGGTTCTGGCTGGGGCTCCTTAAGAACGATAACGATAACACTAACATAGA GTTCAGCATCGACAGTTTCAAGATTGATTTGGAAGAAAAGTTCTCCGGCGTCGGGAGCTTTACATCCTCTTA CTACATCTTTAAGGGCGCGTTTATTCCAACGAACCCAAGCTTAGCTTCCATATCTCCGACAGCAATTACAA AACAGTGCACCCCCTGAAAGGCCTCAAGAACTTCGGTCCACTGGATTACTCATTTGAAAGCAAACAGACCAA TCAGCAGGCTATTAAACTTGGTATAATCACTCCGATCAGCGGCATGCAACGGATACTCAAACACCCTGAACGA ACTTAATAACGAGATCCGCGCAGCTACGGAAAAGGAGTACCTGACCGATTATTACCCCTTTAGCAACATCTA CAAGAGATACCTTGACATCCCGCAGAATAAGGATAGTAAATTCTTGGAACTCGTGAATGAAGCCGAAGTGAA CAAACTGAACCACCTCGAGTTTTATGACTTCCTCAAACGCAAATTGATTACTTCTATACAATTAGGGGCGA GTTCGACGTGCTTGTGTTGTATTTTCCCAAAGGCTGGACTAAGTTCCGCGAGCTGAAAAATGACAGTGTCTA CTTTGATCTGCACGACTCCATCAAGCTGTACTGTGCTAAGAAGAATATCAAGATCCAATTCGTGGAAGATAA GAGTATAGACTACCTCGACCCGGCCAAGGTTAATGGTGGTTGAGCCTCGGCTTGTATGTCAAAGCGAACGG GCTGCCCTGGCGGAACGTGGTCGTAAACGAAAGCACCGCGTTTGTCGGGCTCGACTTCGCGGTCCAGCGAAT AAACAACAGTAACAAGTACGTGCTGGGTAGCTCACAGATCTTCGACAGCTCCGGACAAGGACTCAGGTTTCT GTTGCAGCCCCATCGAACACCCTGTGTTTATCGGTAAAAACCCCTTCATGAGCAAGGAAGATGCGCGACGGAT |

TABLE 19-continued

Argonaute nucleic acid sequences containing 2 nuclear localization sequences and a cloning sequence

| SEQ ID NO | Argonaute | Sequence |
|---|---|---|
| | | GATTCTTAAATTGAAGGAAGCGTATTTTAGGATTGACGGTAACTCCAAGCTGGAAAAACTGGTGGTGCACAA<br>AGTACTGCATTACACAAATGATGAGATGACCGGCATTTCCGAGGCGCTGGAAGGTATTGAGAACATTGAGCT<br>TCTGCAAATACAGAAGTATAGTAAGTGGAGGGCAATTAGAGGGGACATCGATCGGTATACGGGAAAGGTGAA<br>GACCGACCCGCACAATTTCCCGATCCAACGGGGGACAGTGATCCAGCTCGACGACTTCTCTTTCCTTCTGTG<br>GACACATGGAAGTGTACAGGAAGACGACGTGGCTGGTAGGCACATGAATTACTACCAGGGTAAGCGCGGGAT<br>TCCCGCACCACTTCTCATACGGAGGTTTCGCGGCACCGATCCGATTGAAATGACCGTGCGAGACATCCTGTC<br>ACTCACCAAGATGAACTGGAACGGAGGCGAACTTTACAAGACTCTGCCGGTGACCCTGGATTTCTCTAAACG<br>GCTTTCTAAGTATGCGAAGCAGGCAGAGACCCTCCAGGCAATACCCTACGACTTTCGGTTCTTCATGTAGTA<br>ACTCGAGGTTAACTTGT |
| 334 | 51 | GGTGTCGTGAGGATCCATGCCAAAGAAAAAACGAAAAGTAGAAGACCCTAAAAAGAAGCGGAAAGTAGGGTC<br>AGGCTCTATGCTTCAACTGAACGGCTTTAGCATCGAAATCGCCGGAGGTTCCCTGACTGTCTTGAAATCTAA<br>AATCGCGCCTACCGACGTTAAAGAAACCCGCAGGAGCCTGGAAGACGACTGGTTCACCATGTATCACGAGGG<br>CCACTTGTACTCACTTGCAAAAAACAGCAACGCATCCGGCGGATTGGGTGAGACCGAGCTCCTGGTCCTGTC<br>TGATCATCTGGGTCTTAGGTTCGTTAAGGCTATGTTGGACCAAGCCATGAGGGGCGTATTCGAGGCCTACGA<br>CCCCGTTAGAGATAGGCCCTTCACATTTCTGGCGCGAAACGTAGATCTCGTAGCCCTCGCGGCAGAAAACCT<br>CGAGTCCAAGCCCAGCCTTCTCTCCAAATTCGAGATCAGGCCCAAGTACGAACTGGAGGCCAAGGTAGTGGA<br>ATTCAGACCGGGCGAGCTGGAACTTATGCTGGCGCTCAATCTGACTACACGGTGGATCTGCAACGCCTCCGT<br>AGACGAGCTCATTGAGAAGAACATACCGGTCCGAGGAATGCACCTGATCCGACGGAACCGGGACGCCGGACA<br>GAGAAGCTTGGTTGGCACCTTCGACCGCATGGAAGGCGACAACGCCCTGCTGCAGGATGCTTACGACGGACA<br>AGACAAGATAGCAGCCTCACAGGTGAGGATCGAGGGGAGCAAGGAAGTCTTCGCGACCTCTCTGAGGAGGCT<br>CTTGGGCAATCGCTATACCAGTTTCATGCACTCCGTGGATAACGAGTACGGCAAGTTGTGCGGGGGTTTGGG<br>GTTCGACGGCGAACTTAGGAAGATGCAGGGATTTCTCGCGAAAAAGAGTCCTATACAACTGCACGGAGGTGT<br>AGAAGTGTCCGTGGGGCAGAGGGTACAACTTACCAATCAGCCTGGGTATAAGACAACAGTTGAGCTTTTGCA<br>GTCAAAGTACTGCTTTGACAGAAGTAGGACGAAGCTCCACCCCTACGCCTGGGACGGGCTTGCTCGATTCGG<br>CCCATTCGACAGGGGCAGCTTCCCGACGCGATCCCCCAGGATTCTGCTCGTGACACCCGACTCCGCGAGCGG<br>TAAGGTCTCTCAAGCTCTGAAGAAATTCCGCGACGGGTTCGGCAGCAGCCAGAGCAGCATGTATGACGGCTT<br>CCTCGACACCTTTCACCTCAGTAATGCTCCTTTCTTCCCCCTTCCCGTGAAGCTGGACGGCGTGCAGCGCAG<br>CGACGTGGGCAAAGCTTATCGAAAGGCGATCGAAGATAAACTCGCACGAGACGACGACTTCGACGCCGCCTT<br>TAACATTCTCCTGGACGAGCACGCCAATCTGCCGGACAGCCATAACCCCTATCTGGTCGCCAAGTCCATCCT<br>CCTCTCCCACGGCATCCCAGTGCAAGAAGCACGAGTGAGCACTCTGACGGCCAACGAATACAGCCTGCAACA<br>CACCTTCAGGAATGTCGCCACAGCCCTGTACGCCAAATGGGTGGTGTCCCATGGACCGTTGACCACGGGGA<br>GACCGTGGACGATGAGCTGGTAGTAGGAATCGGAAACGCGGAGCTTAGCGGGAGCAGGTTCGAGAAAAGACA<br>GAGGCACATCGGAATCACGACAGTGTTTAGGGGGACGGCAACTACCTGCTTAGCAACCTCAGCAAAGAGTG<br>CCGATACGAGGATTACCCGGACGTACTCCGGGAGAGTACCATCGCCGTGTTGAGGGAGGTTAAGCAAAGGAA<br>CAATTGGTTGCCGGGTCAAACCGTGCGAATCGTTTTCCACGCCTTCAAGCCTCTGAAAAACGTGGAGATTGC<br>CGACATCATCGCGAGCTCTGTAAAGGAGGTAGGCTCCGAACAGACCATAGAATTTGCATTCTTGAATGTTTC<br>CCTCGACCACTCCTTCACCCTTCTGGACATGGCTCAAAGGGGAATAACGAAGAAGAATCAGACCAAGGGGAT<br>ATACGTTCCCAGGAGGGGCATGACAGTCCAGGTTGGGCGCTACACCAGGCTTGTAACCAGCATCGGTCCGCA<br>CATGGTAAAAAGGGCAAACCTTGCCCTCCCGCGACCCCTGTTGATTCACCTGCACAAGCAGAGCACCTATCG<br>GGACCTGAGCTATCTGAGCGAACAGGTTCTGAACTTTACCACCCTGTCCTGGAGGAGCACCCTCCCCAGCGA<br>GAAGCCTGTTACCATTCTCTACTCATCACTGATAGCCGACTTGTTGGGAAGGCTCAAGTCAGTGGATGATTG<br>GAGCCCCGCAGTGTTGAATACCAAACTGAGGAATAGCAAATGGTTCCTGTAGTAACTCGAGGTTAACTTGT |
| 335 | 28 | GGTGTCGTGAGGATCCATGCCAAAGAAGAAGAGAAAGGTTGAGGATCCCAAGAAAAAGCGGAAGGTCGGCAG<br>TGGCAGCCTGGGAGCCGGTGCCAGCATCAGTTCCGGCATCCAAAGCGCTAATGACTGCATTTGGGACTGGAA<br>GTACTCTATCTACCAAACTAACTCCGGCAGTCAACGAGTGGCCCTCGTGGACCCTAAGAAATCCGACGCCTC<br>CAAGTCTATCATCCAGAAGTGGCTGGATAATCAACCGAAATTCTCACAGATCGAAGCCCATCAGGAGTACAG<br>CTTCTACGCCCAGGCGGCTTACCCCATTGAGGCGGACCGAATCAAATACTTTCAGAATCTCTTCCAGGGGAA<br>GTCCCCCTATATCGGCTACAAATTGCTCTGCCTGCTGAACAAGTACGGTGTAGTGAAATCTGTGTGGAGTAC<br>CAACTTCGACGGCCTGGTCGAACGGGCAGCACAGCAAGCCAACATCACCCTGATCGCCATCAATCTTGACTG<br>TGTTGACCGCATATATCGAGCAGAAAGCGTGAATGAACTTCTGTATATCGCGCTCCACGGGGACTACAAGTT<br>TAGTACCATAAAGAATACCGCGAATGAGCTCGACAGCCAGCACACCGAGTTCGTATCTGCCATGTGCCGGTA<br>CTTCGTCGATAAAAACTTGATCGTCATGGGATACAGCGGACGCGACAAGTCACTTATGGACGCCCTGGTCCA<br>AGCGTTTAGCAAGAAGGGTGGGGGGGAGACTTTATTGGTGCGGCATGGGCGAGACCATCACGATCGAGGTGCA<br>AAACCTGATACAGAGAGTGAGGACCGCAGGCCGGTCAGCTTATTATGTAGATACCTCTGGGTTTGACAACAC<br>CATGCTGTCACTGGTAAAGTACTGTTTTTCAGAGGACGTCGCCAAACAGCGAGAAATAAACGAAATTTTGAA<br>AATTGTGGAACCGGAGCAGATTACTCCGTTTGAGATTCAAAAGAGCCAGAACAAACGGTATCTCAAGAGCAA<br>CCTGCTGCCAATCGTGCTTCCCAAGGAACTCTTTCAGTTTCAGATCTTTATAACGACACGGCGGACAGGTG<br>GGGATTCTTGCGCGAGAGGATTAAGGAGCGGGAAATCATAGCAGTCCCGTACCAGGACAAAGTATACGCAAT<br>CAGCACGGTCTCCATCATTAACGACGTTTTCAAGGACTGTCTCGTAAGCGAGATTGAGCGCACGTCCATCTC<br>TCTGAATGAGATCGAGCGCAATGGCTGCTTCAAAGAGCTGTTCCTCAAGGCTATTCTCTACGGGTTTAGCCA<br>AATCCGGAATCTGGGCATCAACTACCGCCACGGCATCATTTGGAAGAAGGAGGCGCTCTACACTGAGCCCGG<br>CAAGACCGTACACGAGGCCATAGAATGCGGCTTGTCTTTTATACCGCAAGCGAACTACGCTTTGATTAGCAT<br>CACACCAAGTTTGCACATCGAATCCAGCAGCCCGATTGAAAAAGACGAAAAAGAAGTATAACAGGCGGTA<br>CCTTGACAAGATGAGGAATAAAGAGTACGAGGAAAAGATCCAGGAGTGGTGCAACATACTGTTCTCCGGTAA<br>CAAGCTCGTTTTTGACATCCCGCTGCAAAGCAACAACGACTTGAAGTTCTTCATTTCCAGTAATAGGGGTTT<br>CGCCGAGGTATACAATTACGGTAAGGACATCGAGAAGAGCTACACGCCCAATGCTTACAATACGAAACAGAC<br>CATTTACTACGGCATGCAAATCGAAGAGCCTCAGTTGGAGTTTATCAACTCCATAATCAGTAGGCCGTTCTA<br>TGACGTTAACCCAATGAGGGGCCTCTCAAATCACAAACCATTCGACGCGGACTACTATGACAAGTTCCCCCA<br>GGATGTGTGTTTGGGCATTGTGTGTCCGACCAGCTACAGCCTGATGTTCTCAGAATTCCTGAAGCGCCTGAA<br>CACTAAGATCCCAGCACCGAAGTCATCCGACTACATCCACAACTATATTGGCTTTAACAGCATCTACAACTG<br>CAGGCTGGACATACCGGACATCAATGCCGATCGCTGGGTGAGCATCGGCGACAACCCCCAGAACGCGGAGGA<br>ATTGGCCCGCAACATCTGTATGGAAGCAAAAAAGCTGAGTGAACAATATCCGGGCATCGTGGTTAACATATT |

TABLE 19-continued

Argonaute nucleic acid sequences containing 2 nuclear localization sequences and a cloning sequence

| SEQ ID NO | Argonaute | Sequence |
|---|---|---|
| | | CATCCCTACTATCTGGAGCAACTACAGAAACTTTAAACACAACGGTGAATTCTTCGACCTGCATAACTACAT
TAAAGCATTTGCGGCACAAAATCGCTTCACCACGCAACTCATCGAGGAGAAAACTGTTTGTAACACGATGAT
GTGCGAGATATCCTGGTGGCTTTCCCTTGCCCTTTTCGTTAAGACCCTGAGGACTCCGTGGACACTGGCTGA
CCTTAACCCCAACACCGCCTACGCGGGGATAGGGTATTCAGTTAAAAAGCAGGCCAAGGGCAGGACAGAGAT
CGTACTGGGGTGTAGCCACATTTACAATGCGCAGGGACAGGGACTCAAGTACAAACTGAGCAAGGTCGAGCA
CCCACAGTTCGACAAAAAACGGAACCCATTCTTGAGCTTCGAGGAAGCCTTCAAATTCGGGATGGATATTCT
TAATTTGTTCCAGAGTGCAATGGAAAAACTGCCGCAGAGGGTGGTTATTCATAAACGGACGCCTTTTAGGGA
AGAGGAAATAGAAGGGATTACCAGCGCCCTCAAGCGGGCAGGGATCACGGAGGTGGACCTGATCACTATAAC
GCAGGAGCGAAACATTAAGTTTATAGCACAGGTTGTCTCCTTCGGCCAACTCAATACCGACGGCTATCCCGT
CAACAGAGGCACTTGCATCAAGCTTAGCTCTCGCAATGCACTCCTTTGGACCCACGGCGTCGTCCAGAGCAT
TCGAGACAAAAGACGGTACTACCAGGGGGGCAGGTGCATTCCGAGCCCGCTGAAAATCACTAAGTATTACGG
CAACGGCGATCTCCAGACTATAGCTAAGGAGATCATCGGTTTCACGAAGATGAATTGGAATAGCTTCAACTT
CTATACGAAGCTGCCAGCGACCATTGACACTAGCAACACCCTGGCCCAAGTGGGCAACCTTCTCAGGAACTA
TAATGGCACCACCTACGATTATCGCTACTTTATCTAGTAACTCGAGGTTAACTTGT |
| 336 | 43 | GGTGTCGTGAGGATCCATGCCGAAAAAGAAGCGGAAAGTAGAGGACCCGAAGAAAAAACGCAAGGTGGGCTC
CGGGTCTATGGCCAACCATACCTTTAACATCCTGACTTTCAACCACCCCCAGGAGGAACAGACCTTCTACTT
CACGGACCAGGAGCAAGACAACCTGACCCGCATCTACAAGAGCCTGGTGCCCGACGAGGTCATCGAGAAATA
TGGCGAGCAGGATCACTACTACACCTCTTTCACCGTAGAGAAGGATGGTTTCCTGGCCGTCAGCAAGCCCAC
AACGCCCCTGTTCGAGACCAAGACTACGGAGGCGGGCGAGGAGAGGAGCTATACCATCAGGAATTCAACGTT
CAGCAGCAGCGTGTTGAAACGGTACTACAACAGCCTTATCCACAGCCACTTCAAGGAGAAGGGCTTCCTGGT
GAAGCCCAACTTCGTGAGCGACACGGAGGTGTGGCTGCCTAGCGCCAAGCAGGACACGACCGGCAAATACAA
AATATTCGACCGCTTTAGCCTGAAGGTGCAGTTCAAGACCGTCTCTGATTCCCTGGAGTTGCTCGTCACGTT
CGAGGGGAAGTCAAAGATATTCAAAGTACCTGTTAGCACCCTGCTGGAGGATGTGAGCCCCACGGACATCAA
CTGGGTTGTGTACGAAAAGGGATTGTACAGGTTCGACGAACTCCCGGACAGCGGCAAGAGGGAGTATGACAA
GGTTTACCCCGTGTGGACCTTCGAGATCAGGGACGCGCTTATGCAGGGCACCGAAGCCCCAGACAAGACCAA
CAAGTACAAAAAGTTCAGGGAGGGCATCGACAAGTTCTATAACCAGTATCTGAACACAGAGGAGTTCAAAGC
CATCATTCCAATCACGTCTAATGGCTTCATCCCGGTCAATAAGATCAATGTCGGTAGTGTGAATAATAGTAG
CAACAGGCTGCTGTTCGGGGAACAAAAGAGCGGTATCGTGCCAATGGACGGCATGAAGGAACATGGCCCATT
CGACTTTTCCAGCACCAGCAAGATCCATTTCTTCTTTATCTTTCATAAAGACGACCAGCACATCGCCCAAAA
GATGGATGGCTATTTCAAAGGCAGCGAGTTCGGGTTCAAGGGACTCACCAAATTCATACACACCCCCTATCA
CACCGAGAAAGGATTCTCAATCAGGTTTGAGGACCGCGACAATCCGTGGCCCGAGATCTACGAAGCCGTCAC
TAACAAGCACTTCGAGTCCGACATACAATACATTGCGATCTACATCAGCCCCTTCAGCAAAAACAGCCCCGA
CAAGAGTCGGCGCAAAATCTATTACAAGCTCAAAGAACTGCTCTTGAAAGAAGGCGTGAGCAGCCAGGTGAT
TGACGGCGAGAAGGTGATGACCAACGAGAAGTATTACTACAGCCTCCCCAACATAGCAATCGCCATTCTGGC
CAAGTTGAATGGCACCCCTTGGAAACTGGACACCAAGCTGAAGAACGAACTGATCGTGGGAATCGGCGCCTT
CCGCAACAGCGAGGTTGACATTCAATATATCGGCAGCGCGTTCTCTTTCGCAAACAACGGCAAGTTTAATCG
CTTTGAGTGCTTCCAGAAGGACCAGACGAAAGAATTGGCGGGAAGCATCATACGGGCGGTGAAGGAGTACGC
CAACGTAAACACCGGCATTAAGAGGCTTGTGATCCACTTTTACAAAAGCATGCGACAGGATGAGCTCCAGCC
GATCGAGGACGGCCTTAAAGACCTCGGCCTGGACATTCCGGTATTCATCGTATCTATCAATAAAACAGAAAG
CAGTGATATCGTGGCGTTCGATAACAGCTGGAAGGATCTGATGCCGATGAGCGGCACATTCATTAAAGTGGG
GTACAACAAATTTCTCCTGTTCAACAACACCAGGTATAATCCAAAGTTTTACAGCTTCCACGACGGGTTCCC
CTTCCCCATCAAACTTAAGATTTTTTGCACTGAAAAGGAACTCGTGGAGGAGTATAAAACGGTTAAAGAGCT
GATCGACCAGGTGTACCAATTTAGCCGCATGTACTGGAAGTCTGTCCGCCAGCAGAACCTGCCCGTGACCAT
TAAGTATCCGGAAATGGTGGCCGAAATGTTGCCTCACTTTGACGGGAATGAGATACCTGAATTCGGTAAGGA
CAACTTGTGGTTCCTGTAGTAACTCGAGGTTAACTTGT |
| 337 | 74 | GGTGTCGTGAGGATCCATGCCCAAGAAAAGCGAAAGTAGAGGATCCAAAGAAGAAACGGAAGGTCGGCAG
CGGAAGTGTGAACCATTACTATTTTTCCGAATGCAAGGCGGACGAGAAAGCCAGCGACATAGCCATCCACCT
TTACACCGTGCCCCTGTCCAACCCCCATGAGAAATACAGCTATGCGCACAGCATCGCCTATGAATTGAGAAA
ACTCAACTCATACATAACCGTGGCCGCGCACGGTCAGTACATCGCGTCTTTCGAGGAGATATGCCACTGGGG
CGACCACAGGTACATACAGCACGAACATAGACCAATCCAGTGCAGCCTCCCGATGGAGAGGACCATACTGGA
AAGACTCCTCAAGAAAGAGCTCGAGAATAGGTGCAAAAGCAGCTATAAGATGGACAACGACCTTTTCCGGTT
GGCTAACGAGCAAAGCATGCACGTGGGCGAGATCAGCATACACCCAGCGATCTACATCTCATTCAGCGTGGA
GGAAAATGGTGACATATTTGTTGGCTTCGACTACCAGCACCGGTTCGAGTACCGCAAAACACTCCAAGACGT
CATCAACAACGATCCCTCCCTGCTTAAGGAAGGCATGGAAGTGGTGGACCCCTTCAATAGAAGGGCCTACTA
TTACACTTTTGTGGGCATGGCCGATTATACCGCCGGACAGAAAAGCCCCTTCCTGCAGCAGTCTGTGATCGA
CTATTATCTCGAAAAGAATGAGCTGTGGAAGCTCAAGGGTGTGCACGAAAAAACCCCGTGGTGCACGTCAA
GAGCCGAGACGGTCACTTGCTCCCGTATCTGCCGCACCTGCTCAAATTGACATGTTCATACGAACAGCTCTT
GCCCAGCATGACCAAGGAAGTCAATCGCCTGATTAAGCTGAGCCCCAACGAGAAGATGAGTAAGTTGTATAC
GGAGATGTTTCGATTGCTCCGGCAGCAAAGGTGCTGACCTTCAAGAAGGAAAACGTGCGAGCCGTCAACCT
CGGCTACGATGTGAATGAACTTGACAGCCCGATCATGGAGTTCGGACAAGGCTACAAGACAAACGAGATCTA
TCGAGGCCTGAAGCAGAGCGGAGTATACGAGCCCAGCTCAGTGGCCGTGAGCTTTTTGTTGACCCCGAGCT
TAACTACGACCCCCAGAAGCGGAAAGAAGTAGGTTGCTTCGTCAAAAAACTGGAGAGCATGAGCGAGGCCCT
GGGAGTAAAACTGAACATAAGCGACCAGCCCCGACAACTTTATGGCCAGCTCCCCAAGGACTTTTTCAAGCA
GGACAACCTCTCATATCATTTGAAATCTATCACCGACCAGTTCAGGGGAACGGTGGTGGTTGTTATCGGCAC
TGAAGAGAACATCGACCGGGCATACGTTACAATCAAAAAGGAATTCGGCGGCAAGGAGGATCTGATGACCCA
GTTTGTCGGCTTCACCTCCTCCCTCGTCACGGAGAACAACATTTTTCACTACTACAACATCCTGCTCGGCAT
CTATGCGAAAGCTGGTGTTCAGCCCTGGATACTCGCCAGCCCAATGCACTCAGACTGTTTCATTGGACTCGA
CGTAAGCCACGAGCACGGTAAGCACGCATCAGGGATAATACAAGTGATTGGACGGGACGGCAAGATTATCAA
ACAAAAGAGCGTTGCGACAGCAGAGGCCGGAGAGACTATTGCCAATAGCACGATGGAAGAAATCGTCAACGA
AAGCATTTATTCCTACGAGCAGATCTACGGGCCAAACCGCGCCACATAACATTCCATAGAGACGGGATCTG
TCGCGAGGACCTCGATTTTCTGCAAGCGTATTTGCGGAGTTTCCAAATCCCATTCGACTTCGTAGAAATCAT
AAAGAAGCCGCGACGCAGAATGGCGATATACTCTAATAAGAAGTGGGTCACGAAACAGGGAATATACTACAG |

TABLE 19-continued

Argonaute nucleic acid sequences containing 2 nuclear localization sequences and a cloning sequence

| SEQ ID NO | Argonaute | Sequence |
|---|---|---|
| | | TAAGGGCAACACCGCTTATCTGTGTGCCACGGACCCCAGAGAATCCGTGGGTATGGCGCAACTTGTCAAGAT CGTACAGAAGACTAACGGATTGAGCGTTCACGAGATAGTGAGCGACGTGTATAAGCTGTCCTTCATGCACAT ACACAGTATGCTCAAGACCAGGTTGCCTATCACGATACACTATAGCGACCTCAGCTCAACGTTCCACAACCG GGGCTTGATCCATCCCCGGTCCCAACATGAGAGAGCACTCCCGTTCGTGTAGTAACTCGAGGTTAACTTGT |
| 338 | 68 | GGTGTCGTGAGGATCCATGCCCAAAAAGAAACGAAAGGTAGAAGATCCCAAGAAAAAAAGGAAAGTGGGAAG CGGAAGCATGGAGAACCTGGCTCTTAGTGCGCTGCAACTGGACTCTAAGCTCGACCGCTACATCGTGTGCAG GTACAGAATCGTGTACCAGAAGCGAGACGAGACCATTCCCGGCGAACAGTTGGCCCGGAAGGCGGCCTACGA GATCCAGAAAGCGAATGACTTCGCCCTTTTGACCAACCTCGGCAATAACACATCGTTTCCCTCAAGCCCAT CTCACAGAGGGGCATTGAAAGCACCCACCTTCAGGCGAATCTCATCGAAGACGGGGACCTGGAGCTCGATTG CTCCATCGAACAACATCAGCAGGCACTCCAGCGGCTCGTGAACCAGACATCAATAAAGCTGCGTGGAAGCT TAAGAAGAGCTCACAGGGCAAACTCGATTACAAAAAGGCAGCTAGCGGGAACACCGAGATCTTTGAGCCAAT TCATAGCACTCGAATCAACGCCCGAGCCACGTATCTTGACGCTTTTTGCTCACTGCAGCTTAGCCCCGAGGT GCTTGCTAATGGAACCGTACTGATAGGGCTGCATCTCAAGCACAATCTGGTAGCAAAGTCTGACATCTCTTT GCAGTGGATCATTGATAAAAGGCCCGATTGGCTGCAGAGCATCAAGAAGGTGCGGCACAGGTACTTCGATCC CGGCAAAGCGCCCCTGGTCGCCGAATTCCTGAGGGTGGAGGACTCCCTGAATGGCAACAGCGTCTTGCCCCA CATGGGCCAGAGTCTTGTTTCATACCACCAAGCGAAGGGACTCTTGTCAGAAAGACAGCTCGCAGAGGCCAC GAAGAGCGTGCTGATAAAGGTAAAATACGGCAAAAACGAGGCGGACCACATCGCATCTCTGGTTGAACCAAT GTTTGATTTCGACACGCTCAGCAAGATCGATAGTATCTTCCTTAACAAGTTGGCAAAGGACCTGAAGTGGAG CCTGAACGACAGGATACGCACTTCCGCGAAAATGGTGAAAGGCTTGTATCTCCCAAACTTCAACTGCAAGCT GGAACAGGTTGACTATCAGATCCTTCACAGGCAGCGACTTAATCACCAACAGATGCTTCAATTCGCCAACGG GGCGAAATCTTCAAGAGAGCAGGACGTGCTGCGACATAAGGCGTTCGGCAACATGACGCGCACACAAGTTAT CCCGCTTATTGCGGGCGAGAAGAACAATACAGAACAAATAAGCAGCTCCTGTGCAACGCATACCAAGCATT GCAACAACTGACCACCACGGAATTGCCTCCGTTCACCAAGTTCCCCAACCCCGTAGAGAACGCAGCCGAGCT GGACGCAAGACTGAATGAACGGTGTCCCCCAAATGCGATACTGCTCATCGGCCTTATCGACAAAAGCGACAA AGTGGCGATCCGCGACACCGCGTTTAGCTACGGTCTTGCAACCCAGTTCATGCGCCTGGATCACAGACCGAA CGTCTACAGCCCCTCATATTTCAACAACGTGGCGGCTGGTTTGTTTTCCAAAGGTGGCGGGCAGCTCTGCGC CATTGATGACATGCCGGGTGAAACCGACTTGTTTATCGGTCTCGACATGGGAGGGATCTCTGTAAGGGCACC AGGCTTCGCGTTTCTGTTTCTGCGATCTGGTGCGCAGTTGGGGTGGCAACTCGCGGACAAACAACAGGGAGA AAGGATGCAGGATGAGGCCCTGATGTCACTGTTGGACAAGTCTCTCACCACCTACCTGAGAAGCTGCTCTGG TGAGCTTCCTAAGCGCATAACCCTCCATAGGGATGGCAAGTTCTACGAAAGCATAGAAGTGATCGAGCAGTT TGAGCAGAAGCACGGCGTGAAAGTAGATGTGCTGGAGGTTCTGAAAAGCGGTGCTCCGGTTTTGTATAGACG AAGCCGCATGGCCGACGGAACCAAGGAGTTTAGCAACCCCAATGTGGGCGACGCGATCTATCTCAGTGATCA TGAGATGATCCTGAGCACGTATAGCGGCGAAGAACTCGGAAAGATATGGGTGACAAGGTCAGCGTCAGGCC TCTTAGGCTGCGCAAGAGATACGGTGATGTGAGCCTGGAGACCCTGGCACATCAAGTGCTCGTGCTGTCTAG GATACACGGCGCTAGCCTGTATCGCCATCCTCGACTGCCCGTGACCACGCACCACGCCGACCGATTCGCAAC ACTGAGGCAGGAAACATGCATAGACGCCCTCTCTAAGATGGACCGGCTCTGTCCGGTCTACCTGTAGTAACT CGAGGTTAACTTGT |
| 339 | 56 | GGTGTCGTGAGGATCCATGCCTAAGAAAAAGCGCAAGGTTGAGGACCCGAAAAAGAAGAGGAAGGTCGGCAG CGGGAGCATGCAGCTGAACTACTTCCCCATAAAGTTTGAGTTTGAAGAGTACCAGATAAAAACTGAGCCCTA CAGCGAAGAACGACTTAAAGAGTTGAGGGCCAGTTACAACGCCACCCACTCCTTTTTTAGAAATGGAGACAA TATATGCATTAGCAACAAGGAAGGCGAGGACATTAGTCTGACCGGCGAGGTGATACCGAAAAGAATTTTCGA CGACAGTCAAGTGACCGCCTCATTGATAAAGCACTTGTTTTTCAGGACGTTCAAGGAGAGGGTTCCCCAACTA TATTCCTGTGGACTTTTACCCCTTCCGCTTCTTCTCCGCCCAGGCTAAAGACGACATCATCTATAACGCCCT GCCCGGCAACCTCCGGAAACGAATCGCTTACAAAAAGCTGATCGAGGTTCAGTTGCGGCTGACGGAAATAAA CGGCATCAAGCAGTTTGGCTTCCTGATCAACATTAAACGAAATTGGGTGTTCAACAAGTCATGCTTCGAGCT CCACTCCGAGGGCTACAACCTGATCGGGGTTGGACGTGCTGTATCCGGAGGGACTGCCGGGGTTGACCGAGGT GCTGGCCCCAAACGAAGAGCTTTTGGGCGTAATCGCGGAAATCGTGGACGACAATGCCAGGATAGAAACCAA CGAGGGCATTAAGGAGTTCCCTCTGAACCAGTTGTTCATCAAGAAAAGCAAGTACAACATTGGCAATTACCT TAGCTTCGCGATCTCTCAGCAAAAGAGCGACGAAATAATGAATCTTATCGAGAGCAAACGCTCCGACATCTA CAATACCAAGGGTCTTTACGACGAGATCTTGAAAATTGCGAACCATCTTTTTTTGCGAGAACAGCGCACCCAT ACTGTTTCATAATAAGGACGGATTCTGCTTTACTGTCGATTCCCAGCCGCTCAGTGTGACGAACAGCATGGA ATTGAAGACTCCAACATTCATATACGATCCAGCGGCCACGAAGACGAATTCTAGCAATCCCGACTTGGGCCT GTCCAATTACGGGCCCTACGACTCCAGCATTTTTGACATAAAGATACCCAACGTGTTGTGCATCTGCAATAG GAATAATCGAGGCAACTTTACAAAGTTTCTGTCTAACCTGAAAGACGGGATACCTCAAAGCCGCTATTTCCA GAAAGGCCTCCAGAAGAAATACGACCTCCAGGATGTGATCCTCAATATCCGAGAAATCCAGGCCTATAGCAT CGCCGACTACCTTAACGCCATCAGGGACTACGATGAGAACAAGCCTCATCTGGCGATCATCGAGATCCCTGC CAGCTTCAAGAGGCAGGCCGACGTGCCGAACCCCTACTACCAAATTAAGGCCAAGTTGTTGAGCCTGGAGAT TCCCGTGCAATTCGTTACCAGCGAGACCATCGGTAACCACAACGAGTATATCCTGAACTCTATCGCGCTGCA GATCTACGCAAAGCTCGGCGGGACCCCGTGGGTCCTGCCCTCTCAACGCAGCGTTGACAAAGAGATAATCAT CGGAATAGGCCATTCCTGGCTTAGGCGCAACCAGTACGCTGGCGCAGAACAGAATAGGGTAGTGGGGATCAC GACCTTTATGAGCTCCGATGGCCAGTACCTTCTGGGTGACAAGGTCAAAGATGTTGCCTTCGAGAACTATTT TGAGGAGCTTCTGAAAAGCCTGAAGCAAAGCATCCAGAGGCTCAGCACAGAGCAGGGCTGGAGCGATGGCGA CACCGTGAGGCTGATATTCCACATATTCAAACGATAAAGAACACTGAATTCGACGTGATCAGTCAGCTTGT CAGAGACATCACGCAGTACAAGATTAAGTTCGCATTCGTAACCATCAGCACTGTGCACCCTTCCATGTTGTT CGACATTAATCAGTCCGGTATCGCCAAATACGGTTCCAATATCATGAAGGGACAATACATACCAAACAGGGG CAGCAACGTTTTCCTGGACGAGAAGACATGCATCGTACAGATGTTCGGCGCGAACGAACTGAAAACGGCCAA GCAAGGCATGAGCAAGCCCATCCTTATAAACATTCGCACCCCCCAGGGGAACTACAATTCAAGCGACCTGAA CGATCTCCTGTTTTATGACCTGGGGTACATCACACAGATATATTTAGCTTTACCTACCTCAGCTGGCGGTC CTTCTTGCCCGGTGAAGAGCCGGCGACTATGAAGTACAGTAACCTCATTTCCAAACTTCTCGGGAAGATGCG GAACATCCCTAACTGGGACGCCGACAATCTTAACTACGGCCTGAAACGGAAAAAGTGGTTCCTGTAGTAACT CGAGGTTAACTTGT |

TABLE 19-continued

Argonaute nucleic acid sequences containing 2 nuclear localization sequences and a cloning sequence

| SEQ ID NO | Argonaute | Sequence |
|---|---|---|
| 340 | 4 | GGTGTCGTGAGGATCCATGCCCAAGAAAAAGCGAAAGGTAGAGGACCCCAAAAAGAAACGCAAAGTGGGCTC<br>CGGAAGCCTGAACCTGAACCACTTCCCCCTTAATCCCGACCTCCCCCTGTACATCACAGAATATGCCCACCG<br>GAACCCGCGAGCGTTGCTCGGATTCGTTAGGGGCCAAGGTTTCTGGGCGCAACAGGTCGGAGAACAGGTACA<br>AGTGTACCACGGTAGACCGCAGCCCACGTTCAGGGGAGTTCAGGTGATCAGCCATACCAGGTTGGACCCCGA<br>CCATCCGGCTTTTGACCAAGGCGTTTTGAGCCTCATCCGACAAGCACTGGTGAGGGCGGGATACGTGCTGAC<br>CTACAGGGAGAGGATGGCTATTCATCCCAGACTGGAGAGGGTTGTGCTGAGACCCCCGGACCGGCACCCAGC<br>AGAGTTGACCGTCCATGCACATCTGCGATGGGAATGGGAGCTTGAAAGGCACAGCGGACAACGCTGGCTGGT<br>TCTTCGACCCGGCAGGCGACATCTGAGCGCCCTTCCATGGCCCGCAGAAGCAGTACAAATGTGGTCCGCCGC<br>TCTTCCGGCCACCTGCCAGAAGCTGCACGCCCTTTGTCTGGACCGAGGCCAACAGATGGCCCTTTTGCGGCA<br>AGAGGACGGCTGGCACTTCGCCAATCCCGGTGCTGCCACTCAAGGAAGGTGGCACCTGTCCTTTAGCCCCCA<br>GGCCCTTCACGAGCTGGGACTGGCACAGGCTGCGCACCATGCGGCTGCATTTAGGTGGGACGAGGTACAGCG<br>ACTCGTGCAACTGACTGACCTGTGGAAGCCCTTCGTGACCTCTCTGGAGCCCCTTGAGGTAGCTGCCCCCAT<br>CATTGCCGGGAAAAGGCTGAGGTTTGGACGGGGTCTTGGCCGCGATGTCACGGAGGTGCACAAGCGAGGTAT<br>CCTGGAACCACCCCCACTGCCCGTGCGACTGGCTGTCGTGTCTCCCCATCTTCCTGATGAGCACGCGAACGC<br>CCAGTTGAGGCGGGAGTTGCTTGCTCACCTCCTCCCGCGACACCAAGTACTGAGATCAGCGGAGAGCCGGCA<br>AGGCCTCCACGAGCACCTGAGGAGGCAAGATCAGGACGATACCCTGTATACCTTTTGGTCAGGCGGCGAGTA<br>CAGGAAGCTGGGCTTGCCCCCCTTCGATCTCGCACGAGGCCTGCACACCTACGACCCAGCTAGCGGCCAGCT<br>GCAACAACCGGCTGCCCTGGCACCAGCACCCGCGCAGGCCACGCAAGCGGGTAGGCAGCTGATAGCCCTGGT<br>GGTGTTGCCCGACGACCTGACGCGGTCTGTCCGGGACACCCTGTTTCAGCAGCTCCAGCAGTTGGGCCTTAG<br>GTGTCTGTTTAGTGTGAGCAGGACCCTGCTGCACCGACCACGCACAGAGTATATGGCATGGGTAAACATGGC<br>CGTCAAGTTGGCTAGGACTGCAGGGGCCGTGCCTTGGGACCTGGCAGACCTGCCCGGTGTCACCGAGCAGAC<br>GTTTTTCGTAGGCGTTGATCTGGGCATGACCACACCCACCAACAGTCCCTCCCGGCCTTCACCCTGCACGA<br>CCATAGGGGACGCCCTCTTCAAAGCTGGACGCCTCCCCGACGACCCAATAATGAGAGGCTGTCATTGGCCGA<br>GCTTAAGAAGGGGTTGCATAGGCTTCTTGCACGCAGGAGCGTGGACCAAGTGATCGTGCATCGAGACGGCCG<br>ATTCCTTGCTGGCGAGGTGGACGACTTCACTCTGGCGTTGCATGATCTCGGCATCCCGCAGTTTAGCTTGTT<br>GGCAATaAAAAAAAGCAACCACAGCGTGGCGGTGCAAGCAGAGGAAGGATCCGTGCTTAGCCTGGACGAACG<br>ACGATGCCTTCTTGTTACTAATACCCAAGCCGCGCTTCCGCGGCCCACGGAGTTGGAACTGGTCCATAGCGA<br>CAGGCTTAGTTTGGCGACCCTGACCGAACAAGTATTCTGGCTGACCCGCGTCTTCATGAACAACGCGCAGCA<br>TGCGGGCAGCGATCCAGCCACCATCGAATGGGCCAACGGCATAGCCAGGACTGGACAGCGAGTGCCCCTGGC<br>CGGGTGGCGGCTGTAGTAACTCGAGGTTAACTTGT |
| 341 | 27 | GGTGTCGTGAGGATCCATGCCCAAGAAAAAGAGGAAGGTCGAAGATCCTAAAAAGAAAAGGAAAGTCGGGTC<br>CGGTAGCATGCCCACCCAGTTCCAGGAGGTGGAAGTGATACTCAACCGCTTCTTTGTAAAGAAACTGTCTCG<br>GCCCGACCTTACGTTCCATGAGTACCAATGCCAGTTCACCCAGGTTCCAGAGCAAGGCAGCGAACAAAAGGC<br>CATCAGCAGCGTGTGCTACAAGCTCGGTGTGACCGCCGTGAGGCTGGGCTCATGCATCATCACCAGGGAGCC<br>CATAGACCCTCGAAAGGATGCGCACCAAAGATTGGCAGTTGCAGCTGATCGGATGCGCAGAGCTGAGCTGCCA<br>AAACTACCGAGAGAGGCAAGCTTTGGAGACTTTCGAGCGAAAAATCCTGGAGGAAAAGCTCAAGGAAACATT<br>TAAGAAGACCATCATCGAGAAGGACTACGAGTTGGGCCTGATCTGGTGGATATCAGGCGAAGAGGGACTGGA<br>AAAAACCGGTCACGGGTGGGAAGTGCACAGGGGCAGGCAAATAGACCTCAAGATCGAGACGGACGAAAAGTT<br>GTACCTGGAGATCGACATACATCACAGGTTCTACACCCCCTTCAAGCTGGAGTGGTGGCTGAGCGAATACCC<br>CAACATCCAAATCAAGTACGTGCGCAACACGTACAAGGACAAGAAGAAATGGATACTGGAGAATTTCGCCGA<br>CAAGAGCCCCAACGAGATTCAGATAGAGGCCCTTGGCATCAGCCTTGCGGAATACCACCGGCAAGAAGGTGC<br>TACCCAGCAGGAAATCGACGAGAGTAGGGTTGTGATCGTCAAAAAGATCTCTGACTACAAGGCGAAACCCGT<br>GTATCACCTGTCTCAGAGGCTGTCCCCGATACTGACCATGGAGACCCCTTGCCCAGATCGCCGAGCAGGGTCG<br>GGAAAAGAAGGAGATACAGGGCGTGTTCGATTACATTAGGAAGAACATCGGCACGAGGCTGCAGGAGAGCCA<br>GAAGATCGCGCAGGTCATTTTCAAGAATGTTTATAACCTTAGCAGCCAGCCCGAGATCATGAAGGTGAACGG<br>TTTTGTAATGCCACGCGCGAAGTTGTTGGCAAGGAACAATAAGGAGGTCAACCAGACCGCTAGGATCAAGAG<br>TTTCGGCTGCGCTAAGATCGGAGAAACGAAGTTCGGATGTCTCAATCTGTTCGACAACAAACCGGAGTACCC<br>GGAGGAGGTACACAAGTGCTTGCTGGCGATTGCGCGGAGCAGTGGGGTCCAGATAAAGATAGATAGCTACTT<br>CACGGGGAGCGACTACCCGAAAGATGACTTGGCCCAGCAAAGGTTCTGGCAACAGTGGGCGGCACAAGGAAT<br>AAAGACGGTGCTGGTCGTGATGCCCTGGTCCCCTCACGAGGAGAAGACAAGACTGCGGATCCAAGCTCTTAA<br>AGCCGGCATCGCAACTCAATTTATGATCCCCACGCCCCAGGATAACCCATACAAAGCATTGAACGTTGCTTT<br>GGGTCTGCTCTGCAAAGCCAAATGGCAACCCGTTTACCTGAAGCCCCTGGATGACCCCCAGGCCGCAGACCT<br>GATCATCGGCTTCGACACTTCTACCAACAGGCGGCTCTACTACGGTACAAGCGCCTTCGCGATTCTGGCGAA<br>CGGCCAGTCACTGGGCTGGGAGTTGCCTGACATCCAGAGGGGCGAGACATTTAGCGGCCAAAGTATATGGCA<br>GGTAGTGAGCAAACTTGTGCTGAAATTCCAAGACAACTACGACAGCTACCCTAAGAAAATTCTGCTTATGAG<br>GGATGGACTGGTTCAAGACGGCGAGTTTGAACAGACCATAAGGAGTTGACCCACCAAGGGATCGACGTGGA<br>CATCCTGAGCGTGAGGAAGAGCGGTAGTGGCAGGATGGGAAGAGAACTGACAAGCGGCAATACTGCCATCAC<br>CTATGACGACGCCGAAGTGGGAACCGTGATATTCTATTCTGCCACCGACTCATTCATACTGCAGACAACCGA<br>GGTAATTAAGACAAAAACGGGCCCACTCGGTTCCGCGCGACCGCTCAGAGTGGTTAGGCACTACGGGAACAC<br>CCCGCTTGAACTGCTCGCGCTGCAAACGTACCACCTGACCCAATTGCATCCCGCCAGCGGCTTTCGGAGCTG<br>TAGGCTCCCCTGGGTTCTGCACTTGGCAGACAGGAGCAGCAAGGAGTTCCAACGGATCGGTCAAATTTCATT<br>GCTCCAGAACGTGGATAGGGAGAAGCTGATTGCAGTGTAGTAACTCGAGGTTAACTTGT |
| 342 | 24 | GGTGTCGTGAGGATCCATGCCTAAGAAAAAAAGAAAAGTCGAGGATCCCAAGAAGAAGCGGAAGGTGGGGTC<br>CGGGTCTATGCTCACACAAGAACAATTTATACGCAACTTTAGCGTTATGGCCAATGGTGAAGTAGACTTCTT<br>TCTTGGTGCCGGTCGCATCTATTGCGAGTGGAATCCCAACTGGGGGTGGCTTGATTTGGGAATTTAAGAGGAC<br>ACTGTACTGTAGCGAGTGCGGCATCAGCGCCGAAAAGTACAAGGACCTGTCACTCCCAAGCACGCGCAAAAC<br>GCTCCAGGACTACTTCGACATTAAAGGGTATTGCCCCAAACAATATGCGCCTGAAGGAATACAGCTTCTATTT<br>CGAGCAATGTTACACCGATCCCATGGCCCGAAAGAGGTTCATCGAGAATATGGTTAGTGGGAGGGAGCCAAG<br>TATAGGTTACCTTTGTCTCGCGGAGGCCGTTATGCAAGGCAAAGTTAAAAACATTTGGACTACCAACTTCGA<br>TAGCCTTCTGGAGAATGCCCTCCATAGGCTTTACCCCATGAACAACGTTTTGGTGTGCTCCGAGGCTAATAG<br>AGGCAGTGTGTGCCTGCTCAACCCGACGTACCCAGTCATAGGCAAGCTCCACGGCGACTATCGCTATGATTG<br>GCTCAGGAACACCGAGGACGAATTGCAGCGACTCGAGACCAGCCTTAAAGGTTACGCGTCCAGCCAACTTAC |

TABLE 19-continued

Argonaute nucleic acid sequences containing 2 nuclear localization sequences and a cloning sequence

| SEQ ID NO | Argonaute | Sequence |
|---|---|---|
| | | AGGGAAACAACTCGTCGTTATAGGATATAGCGGGAACGATGAGAGCATTATCAGTTTCCTCAAGGATTGCAT AGATAACCCGGCACTGCTTACCAAGGGTCTGCTGTGGGCTGTACGACGCGGTTCCTGGGTAAACCCGAGGGT TAATGAGCTGATAGAACGGGCGCACAAAATTGGGAAACCAGCCGACGTGATCGAGATCGATGGCTTCGACCA ATTGATGTTCTCAATATACCAGATCCAGAACTACCATAATGAGATTATCGACGGCCAAGGCAGGCTCCTCCA GGTCGGATCTGACATCCGCCTCACGGGGAAGCCCGTGGACAGCTTTGTCAAGCTGAACGCTTACAAGGCTGA GTACTGCCCCCTTTGTAACGTGTTCGAGACAGACATCCATCCTGGAAGGAACTTCGGACCATAACCGGCAG CAGTGACATCATCGCCGGTCTGTTCTCCAAACATATCTATTCTCTGTCTTCCGCAGACAAATTGAAGACCGT GTTCAGCAAGCACTTTCTCTCTAGCATTAACAAGGAGGAGGCTCCCGAACGGGACATTCGACGGAACGAGAG TGTGTACATTGGATTGATTTACCAGCTTATTAAGCGGACCCTGCTTTCAAAAGGGATGGTGTCCTTCGCTAA GAATAAGGTCTATAACCCCGACAGCTGCCGCAGCGAGCAAGGCTACCAAGTTTTTGACGCCCTGGAGATCGC GGTCAGCTTCGTTGATGGAAACCTGTACCTGAATCTTATGCCCACGGTACATGTGAGAGGCTCAAATGGCGA GAGTCTCGACAAAGAGTCCTACCAAATACAAGTCAACCATGTGGTCAGCACAATCTACAATAAGCAATACAA TGAGAAACTGCGGTTCTGGGAGAGCTTGTGTCTGGACAGTGGTAGAATAATCTTCGAGAACGACGGCTTCAG CATATCATTTGTCGCTCCCGCTGTCTCCCTGGGCGGCAACAATCGAAGAGCTAAGTGGCTTTCCATGCCGTC CTGCAAGTATGACGAACCACTCATGTGCTTCTCAGACACTGACAAAAGCAACGAGTTATTAACCAACTGAA GGGACTCTGCCAGTACGGGCCAATCGACTGCTCTTATATGCGGGATAGCACCACAAGGCCCAGCGTTAGGCT GGCCGTTCTGAGCCCGAACCAGGACATGGACCGAATTCTTGCACACCTCAATAAACTCAACACCCACGTCCA AAACAGGGGCAGCGATAATTTCCTGCCCCACTATGAGGGCTTTGAGCAAGTTTACAGAAGGGCTCTGAGCGT CCCTACGAAGGAGCAGAGCAACATCTGCATCGAAATACAACGTGAACGCCATCCTCAAAATGTCTCCTGCAGA GTTTCTGGCTTTTATGAAGCGGGGTATAGAGAAATACTCCCTTCGGTCAAGCGATTTCGATATACTCGTTAT TTACATCCCAGAGTCATTCGCGCATTTCCGGACAGCAACCGAATTAGTAGCGACTACAATCTGCACGATGC GCTCAAACTGTATGCCACGGATAAGGGGATTATCCTTCAACTCATAGAGGAGAAATCTGTGAAGTCATACGA CCCCTGCAAAGTAATGTGGGGCTTGTCCACCTCACTCTACGCGAAGGCGACAGGGGTACTTTGGCATCCAGA GGCAATTAGAAATGACACGGCCTACATAGGGATAAGCTACGCTTTCAGCGAAGAGAAAAGGATTTGTATAGG CTGCAGTCAGCTGTTCGACTCAACCGGGACAGGTATTCGGATGGTCCTTAGAAAGATAAACAATCCGATATT TCTGGGGCGATCCAACCCCTACATGAGGGAAGACGACGCTCGAATTATGATGACCGAGCTCAGGGAGCAGTA TTACCACAGCGCACCTGTGAATACTCTCAAGAGGGTCGTGATCCATAAGACCACGCCCTTCATACGGGATGA GATAGCCGGTATAATGCAGGCATTTAACGGCATCGAGGTCGAGCTGGTTCAGATTCAAGACTATTGCTCTTG GAGAGGCATACGCTTCGGCGGTGAGCCTGGGAAAACGGCGTTTGGGTTCCCGGTGAAGCGAGGTATGGCCGT AAAACTCGACCGAGAAAGCTTCCTGCTCTGGACCCACGGCTGCGTGATTCACCCGGAACTGTCAGGCACGCA TAACTATTTCAAAGGTTCACGCGGTATCCCAGCACCCCTCCTGGTCCGCAGGTTTGCGGGTAACGCAAGTGG CGACACATTGGCAAAAGAGATTCTGATGCTTACGAAGATGAACTGGAACTCCGGTGACAGTCTGTACAAAAC CCTTCCCGTGACCCTGGATTTTGCGAAAGTTCTCGCCCGCATGTCTAAGCAAGATGAGGCGATCTTTGATAA GGCGTACGACTTCAGGTTTTTCATGTAGTAACTCGAGGTTAACTTGT |
| 343 | 62 | GGTGTCGTGAGGATCCATGCCCAAAAAGAAGAGAAAGGTGGAAGATCCCAAGAAAAAGAGGAAGGTGGGTAG CGGGAGCATGAGGGAAACCAACATCTACGAGCTCAGCGGCCTCGAAACCGTGAGTACCAGCTACAGACTTTT CGAGTTGCAGGGCGCGCCAGAGTTCTCTCCTGAGTATTATGCTGGTGTGAGCCGCCTCGTGAGGACGCTTAG CAGGAGACACCAGGCACCCTTCACCAGTATCCAACGGGCGAGACCATGTTGCTCGCTGCACCCGAGGCCCT GAGCGGTGATCTCGCAGAACACCATAATCTGGCACGCTGGGTGGCGACCCTGAAGTCACTTGGAGATAGCAT AGAGATAGACTGCAGCGTGAGCGGAGATGAGCTGGACCCCATAAGGCTGCGATTCCTGAACTTCATGATCCA ATCTCCATTGTTCAACCACGGCGAGCTCTGGCAGCCCAGGGCCGGTGATGCCTTCTACTACCGGAAGCCTGC CGACACGTTCGACGGAATCGAACTGTTTGAGGGTATTGCCGTGAGGGCCGTGCCCTACCCAGGAGGCGGGTT CGGCGTTATGCTCGACGCGAGGACTAAGCTGATCTCACAGCGGGCTGTGGGCGCCTACGCGGACCCGAATTT CATAAGGAGGCTGAAAAACACTAGCTGCCTGTACCGAATGGGAGACATCTGGTACGAGATAAAGATCAGTGG CGCGAATCAGACCGTTTCTCACCCCATCCTGTTTAAGGACAACCAGCCCGTGTCACTCAAAGCCTACCTGCA CGAACAAGCACGGCAGCCAATCCCCAAGTCTCTGATTGATCTTAAAGGTGACGGCGTGGTGTTGACCTATCG CGGCAGCGATAGCGCCGAGGTCAAAGCGGCACCCGCGGAACTTTGTTTCCCCATAGTAGACACCCATAGCA GAGGGGTGCCCGGCACCAGAGAAGGAGCATCCAAGCCCCACACATCCGACGCAGCAAGGCTTACCGATTCAA GCAAAGGTTCTTGCGGGACATCAAAATAGGAAATGCCGTGTTGAGCGTGGCCGACCAACCCGCAGCCCTCAA GACCAGGCCCATCGACTTGCCCGAGCTGCAATTCGGCTCCAATAGGATTCTGTACGGCACGGACAGGGCGG AGACCGAATCGACCTTCGCCAGTATGCCAAGAATCGGCGAACGCTGCTGGAGCGCGCAGACGTGGGCTTCTT TGAGACTTCTCCCCTGGAGCCCCAATGTTTGGTACTTCCTAAGAGCGTGATGAACGCATGGGGCAACGAGTT CGTTCGAGACCTGACTGCCGAAGTGAAGCGACTCCACCCCACCGGTAACTACAAGCCAACCGTAATCGCGTT TGATGATGTCAGCGCAACCGTGGACGCCAGGAGCCAAGCAGAAGCCATCTTCAAGCTCGCGGAAGACGGGGA TCTCCCTCCAGGCGACTGCGCCATTATGATACACCGAACCAAAGGAAAGGCAAGAGCGCAGGAGGAGGCTGCC CGCACTTCTTATAAACAAGCTGAGAAAGAGCTACGGAGTGAATGCCGCCATATTCCACGCGACTGTCCCCGG CAACGCCTACCGAAGGGAAAGCGCCAGCGATGGCGCTCGCTATGTGCGCAAGCGGGATGAGAAGGGCAGGTT TAGTGGATACCTGACCGGAGCGGCGCTTAACAAGATTCTTCGCCCAACGCCAAGTGGCCCTTCGTGCTCAA GGACGAGTTGGTGGCAGATATAGTGGTGGGCATAGATGTGAAACATCACACCGCAGCTCTCGTTTTGATCGC CGAAGGCGGAGGATTATCAGGCACACTCTTCGCCTCAGCACCAAGAACGAGAAACTCCCTGCTGGTATCGT GGGAAACGAAGCTGGTGAACTGATTTCAAATGAAGCACCACACCTGAGCAGGCTCACCAAAACAATCGCCAT CCATAGGGACGGCAGGATTTGCCCTCCGAGCTTAAGGGATTGCGAGCAGCCTGTAGGAAGCTTGCCGACGA CGGCCACATCGATCCTGCGTTCGATCTGAACGTCTTCGAGGTGAGCAAAAGTGCCCCTGCTAGGCTTAGGCT GTTTAGCGTCGACCGCAGTGCTGGCAGAAAGCCGAGGATTGAAAACCCGGAACTGGGGGACTGGATGATGCT GACAGAAACCGACGGCTACGTTTGCACGACCGGTGCTCCGCTGTTGAGAGGTGGTGCGGCTAGACCCCTGCA TGTAAAGCAGGTCGCAGGTGATATGAGCTTGCAGGACGCCCTTTCCGACGTGTTCCGACTGAGCTGTCTGAC CTGGACTAGGCCCGAGTCATGTAGCAGGTTGCCTATCAGTTTGAAGCTCTGCGATATGCTGCTGATGGACGA GGGAACTGCCCACGACGAGGACGAAATCCTTCATGCTAACGACGACACCCCAGCCGTTAGCGCCTAGTAACT CGAGGTTAACTTGT |
| 344 | 55 | GGTGTCGTGAGGATCCATGCCCAAAAAGAAGCGAAAAGTAGAGGATCCAAAGAAAAAGCGGAAGGTCGGGAG CGGCTCCATGGCGTTTAGGCCCGGTGAACGAGTCAGACCGCAGCTCGCGCTGAATGCGATCAGGGTCCTTAC ACCCCCTGGCACCATCCCCGCCAGTGTAGTCCAATTCGACAGAGCGCTGCTGCACGCATATCTTGACAGACC |

TABLE 19-continued

Argonaute nucleic acid sequences containing 2 nuclear localization sequences and a cloning sequence

| SEQ ID NO | Argonaute | Sequence |
|---|---|---|
| | | CGAGAACGACGTATTCGCTACCCGACACGGGGAGACTGATATGGCGGTCGTACCCCTGACCAGCGGTGCGAA<br>CCTGCCAACGGACAGAATGGGGCTTCCAGCTGCAGAGCACCTCAGGCTGGTATCTGCGCTGACAAGAGAAGC<br>TGTGTTTCGCCTCCTCGCGGCCAGCCCGGAAGCGGATCTGCTGATCCGGCGACGCCCACCGACCGTCGCGGG<br>GAAGAGAGAAAACGTACTTGCAGAGGACATTGGGCTCCCGGACTGGTTGAAGAAAAGACTTGTGCTGGAGTT<br>CGACACGCGCATATTGCAACCACCGAGAGGGGACGCCTACGTGGTGCTGACGTGTAGTAAAAGGCTGCGCAC<br>GACAATAGACGCGAGTTGTCGCACCCTTCTGGAACTCGGTGTACCACTGACGGGTGCCGCAGTCAGCTCCTG<br>GAGGGAAGATCCTGACCCCAAGGTGAGCCGGCGATTGGCCTACGCTGGGCGCGTTGTAGAAGTAGGGCAGGA<br>CACGCTCACTCTGGACGACCACGGAGCTGGTCCGAGTGTTGTCTCCAGCGAAGACGTGTTCCTCGAGCCGAC<br>TCGAGCAAACTTCAACAAGGTGGTGGAAGTGATAACCCAGGGTAACTCCGAACGAGCCTTCAAGGCCGTACA<br>AAAAGCAGAAGCCGAATGGCACGGCGGGAGGCGGACAATCGAAATAGTGCATGGTGTCCTCAACCAACTCGG<br>CAACCGGTCAATGGTTCTTGCCGATGGCGTGCCTCTGCGGCTCGGGGGCTTGATAGACCAAGCGGTCGATAG<br>CGACGCATTCCCCCCAGCCGAGGCGGTGTGGCGCCCTAAGCTCTCATTCGACCCCGTGCACAGCCCCGAGAC<br>ATCAAATTCCTGGAAACAGCAGTCACTGGACAGGACGGGCCCTTTCGATAGGCAAACCTTTGAAACAAAGAG<br>ACCGCGAATCGCGGTTGTCCATCAGGCCGGAAGAAGGGAGGAAGTGGCTGCGGCGATGCGCGATTTCCTCCA<br>CGGAAGGCCTGACATCGCCAGCGATACGGGCCTGGTTCCCCACGGTTCAGGACTCCTCGGACGCTTTAGGCT<br>CCACGAACCCGAAGTGAGATACTTTGAGGCCGCAGGCAGGGGGGGACCCGCTTATGCCGACGCAGCACGGAG<br>TGCGCTCAGGGACGCGGCGTCAAGGGACGAACCATGGGACCTCGCAATGGTGCAGGTAGAGCGGGCGTGGCA<br>AGATCGCCCACATGCCGATAGCCCGTACTGGATGAGCAAGGCAACGTTTCTCAAGAGGGATGTGCCGGTGCA<br>AGCCCTTAGCACAGAAATGTTGGGTCTTGATGCATTTGGGTACGCGAACGCACTTGCGAACATGTCACTTGC<br>AACGTATGCGAAACTGGGCGGTGCCCCGTGGCTTTTGTTTGCCAGGTCACCAACCGACCATGAACTGGTGGT<br>CGGGCTCGGAAGCCACACTGTAAAAGAGGGCCGAAGGGGTGCGGGTGAGAGGTTTGTCGGTATCGCGACCGT<br>ATTCAGCAGCCAGGGCCATTATTTCTTGGATGCCAGGACAGCCGCGGTCCCGTTTGAAGCCTATCCTGCTGC<br>CTTGAGCGACAGCATCGTTGACGCGATCAAAAGGATTGGACGGAGAGGAAGCCTGGCGACCAGGCGAGGCCGT<br>CAGGTTGGTCTTTCACGCCTTCACCCAGTTGAGCCGAGAAACCGTTCAGGCAGTGGAGAGAGCAGTAGCAGG<br>CATCGGGGCCACCAACGTAAGCTTCGCGTTTCTGCACGTTGTCGAAGATCACCCGTTTACCATGTTTGACCG<br>AGCGTGGCCAGACGGAAAGGCGACATTCGCCCCTGAAAGAGGTCAGGCGCTTCGACTCTCCGAGCGCGAATG<br>GTTGTTGACACTTACCGGCAGGCGCGAAGTTAAGAGCGCCAGTCACGGGCTGCCTGGGCCGGTTCTGTTGCG<br>ACTTCATGACAGCAGCACCTATAGAGACATGCCCGTGCTCGTCCGACAAGCATCCGACTTCGCCTTCCACTC<br>TTGGCGCAGTTTTGGACCCAGCGGACTCCCCATCCCGTTGGTTTACGCGGACGAAATTGCAAAACAGCTCAG<br>CGGCTTGGAAAGAACCCCCGGATGGGACACGGATGCGGCTGAGGGTGGCCGGGTTATGAGAAAGCCTTGGTT<br>TCTGTAGTAACTCGAGGTTAACTTGT |

Example 10: RHDC Expression and Purification

A synthetic codon-optimized gene encoding Argo # was cloned into the pETM-30 expression vector. The subcloned Argo plasmids were transformed into *Escherichia coli* BL21 (DE3) (New England Biolabs) according to manufacturer's instructions. Strains were cultivated in LB medium (Carl Roth) containing 50 µg/ml Kanamycin (Carl Roth) in a bacterial shaking incubator at 37° C. and 150 rpm. After overnight incubation, the preculture was used to inoculate expression cultures (150 ml) with a starting OD600 nm of 0.05. The cultures were incubated at 37° C. and 150 rpm until OD600 nm of 0.6-0.8 was reached. AGO protein expression was induced by adding 1 mM of isopropyl-b-D-thiogalactoside (IPTG) (Sigma Aldrich). Expression was continued in a bacterial shaker at 30° C. and 150 rpm for 6h. Cells were harvested by centrifugation at 5000×g for 10 min at 4° C. The pellet was frozen and stored at −80° C. The frozen cells were thawed at 4° C. and resuspended in 25 mL Buffer I (50 mM Tris/HCl pH 7.5, 0.5 M Sodium chloride, 5% Glycerol) supplemented with 1 mM Phenylmethane-sulfonyl (Carl Roth) and 5 mM β-Mercaptoethanol (Sigma Aldrich). The resuspended cells were disrupted by sonication with a Branson Digital Sonifier (Model 102C, 3 mm tip). Sonication: Step 1: 25% amplitude; 5 sec ON, 2 sec OFF for 2 min; repeat twice; pause for 3 min after each cycle; Step 2: 35% amplitude; 5 sec ON, 2 sec OFF for 30 sec. The lysed pellet was kept on ice during sonication. The lysate was centrifuged for 15 min at 15000×g at 4° C., after which the supernatant was used for His-Tag affinity chromatography purification. The Ni-NTA agarose (Qiagen) was equilibrated in 10 CV (column volumes) Buffer I supplemented with 5 mM β-Mercaptoethanol and after centrifugation (50×g for 5 min) diluted with Buffer I in a 1:1 ratio. The cleared lysate was incubated with 350 µl of the diluted Ni-NTA agarose suspension on a rotary wheel (30 min at 4° C.). After centrifugation (50×g for 5 min) the Ni-NTA agarose beads were transferred to an empty Bio-Spin Chromatography column (Biorad). The column was washed with 60 CV (column volume) of Buffer I supplemented with 5 mM β-Mercaptoethanol. The His-tagged AGO protein was gradually eluted with Buffer I supplemented with 5 mM β-Mercaptoethanol and increasing concentrations of Imidazole (Elution fraction (EF) 1: 25 mM-11 CV; EF 2: 50 mM-11CV; EF 3: 75 mM-11 CV; EF 4: 125 mM-2.5 CV; EF 5: 250 mM-2.5 CV; EF 6: 250 mM-2.5 CV; EF 7: 250 mM-2.5 CV).

Argo proteins and empty control (only expression vector-control for protein prep impurities) were purified, run on SDS-polyacrylamide gels and stained for 1h in coomassie blue then de-stained in a solution containing water/acetic acid/methanol. The protein was quantitated using Image J, FIG. 15A, FIG. 15B, FIG. 15C, FIG. 15D, and FIG. 15E.

Figure 16:
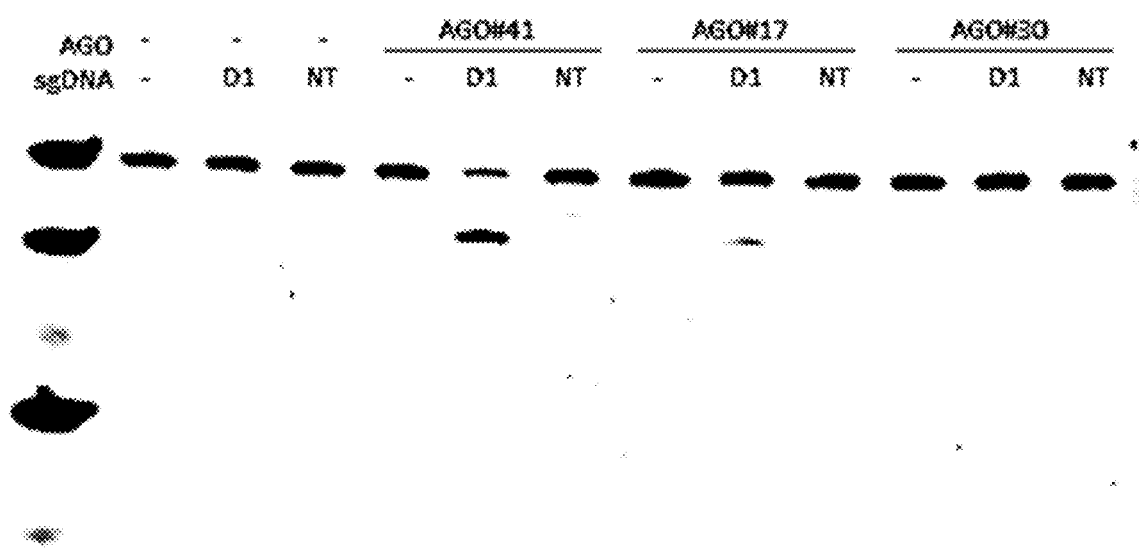
FIG. 16 shows results of a ssDNA cleavage assay utilizing Argo #41, #17 and #30.
Figure 17:
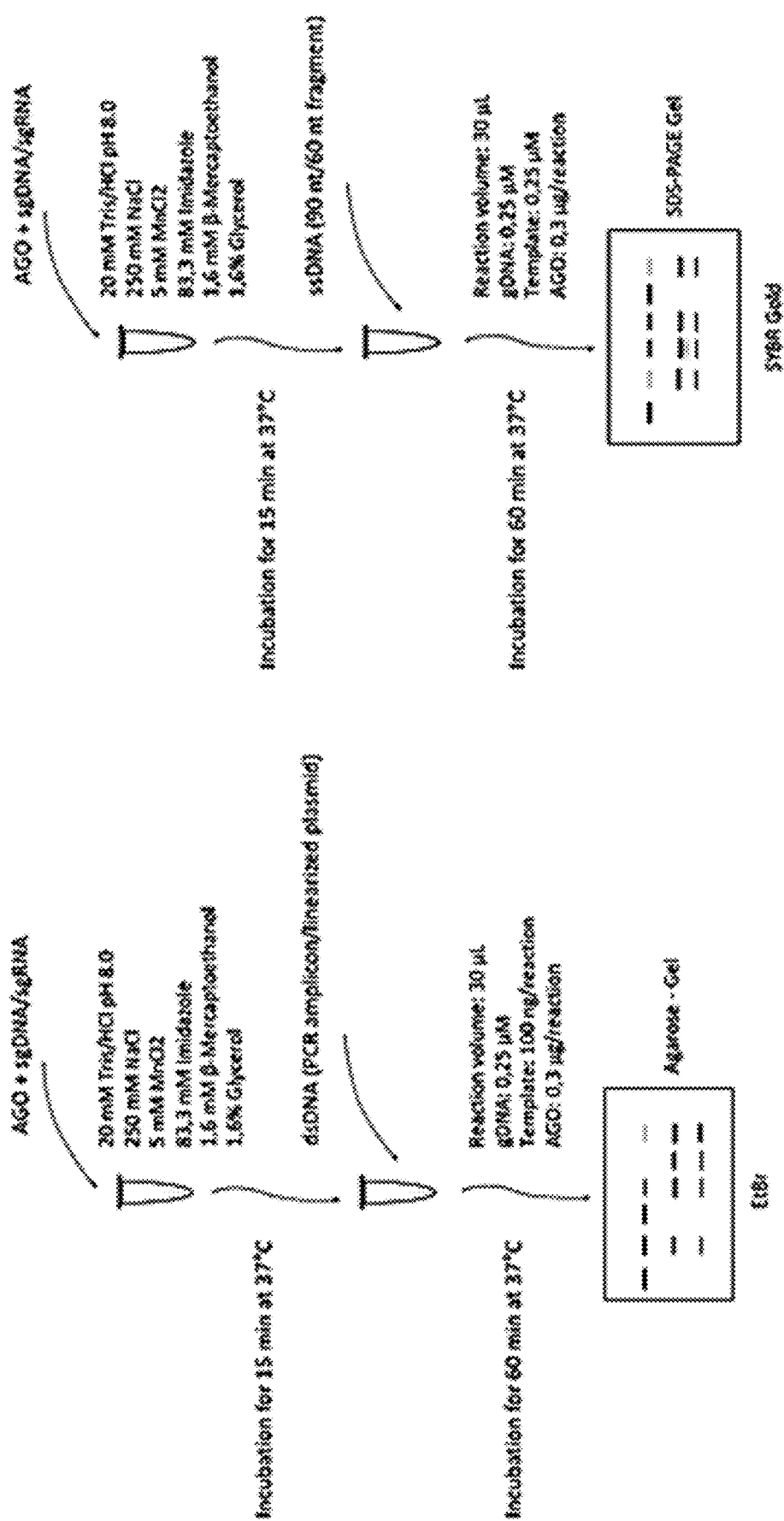
FIG. 17 shows a schematic of a dsDNA/ssDNA cleavage assay.

To determine if the sonication protocol initially utilized for Argo #41 was functional using other Argo sequences, Argo #17 and Argo #30 together with Argo #41 were tested to see whether sonication conditions hold true for other Argos. As used herein, Argo sequences can be referred to interchangeably as AGO # or Argo #. Sequences for the Argo # can be found, for example, in Table 18. The Control cleavage assay was done with 2.5 uL of each prep. Since AGO #17 and AGO #41 showed ssDNA cleavage, the concentration of used protein preps with Image J using BSA standards was evaluated at: Argo #41: 0.58 µg/reaction, Argo #17: 0.15 µg/reaction, and Argo #30: 0.53 µg/reaction. Based on this, 0.3 µg protein/reaction was utilized, FIG. 16.

TABLE 20

Argo Protein Quantification

|  | MW [kDa] | μM | μg/μL | μg/mL |
|---|---|---|---|---|
| Argo#4 | 108.62 | 1.486 | 0.16 | 161.36 |
| Argo#7 | 117.17 | 0.200 | 0.02 | 23.45 |
| Argo#8 | 114.12 | — | — | — |
| Argo#9 | 106.86 | 3.313 | 0.35 | 354.01 |
| Argo#10 | 137.98 | — | — | — |
| Argo#16 | 104.72 | 0.295 | 0.03 | 30.86 |
| Argo#17 | 115.23 | 0.487 | 0.06 | 56.11 |
| Argo#19 | 118.25 | — | — | — |
| Argo#20 | 114.38 | 4.114 | 0.47 | 470.50 |
| Argo#21 | 128.66 | 1.260 | 0.16 | 162.16 |
| Argo#23 | 125.36 | 0.331 | 0.04 | 41.48 |
| Argo#25 | 115.64 | — | — | — |
| Argo#26 | 144.52 | — | — | — |
| Argo#27 | 116.49 | 3.819 | 0.44 | 444.93 |
| Argo#29 | 118.77 | 0.445 | 0.05 | 52.91 |
| Argo#30 | 111.47 | 1.852 | 0.21 | 206.49 |
| Argo#41 | 118.42 | 1.920 | 0.23 | 227.31 |
| Argo#63 | 118.35 | — | — | — |

TABLE 21

Lysis Conditions

Figure 13A:
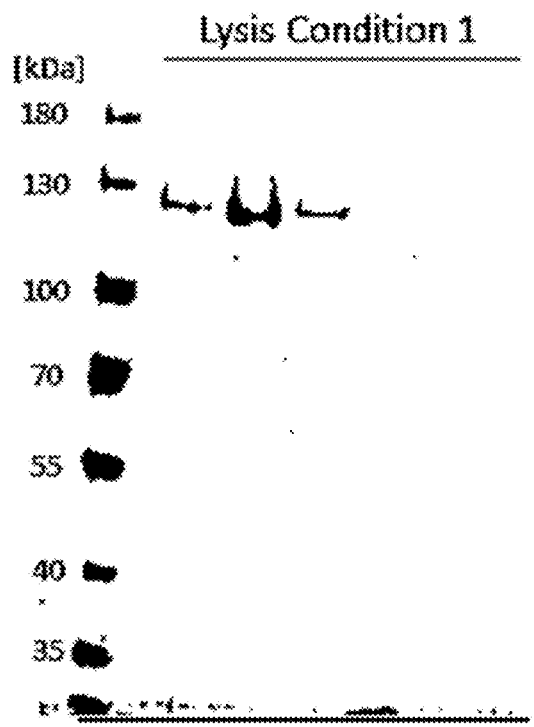
FIG. 13A shows a coomassie Blue stained gel of lysis condition 1 of Argonaute (SEQ ID NO: 190).
Figure 13B:
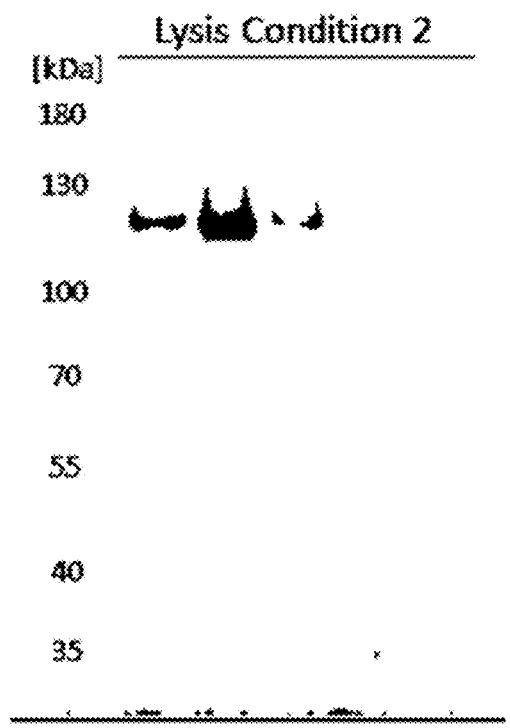
FIG. 13B shows a coomassie Blue stained gel of lysis condition 2 of Argonaute (SEQ ID NO: 190).
Figure 13C:
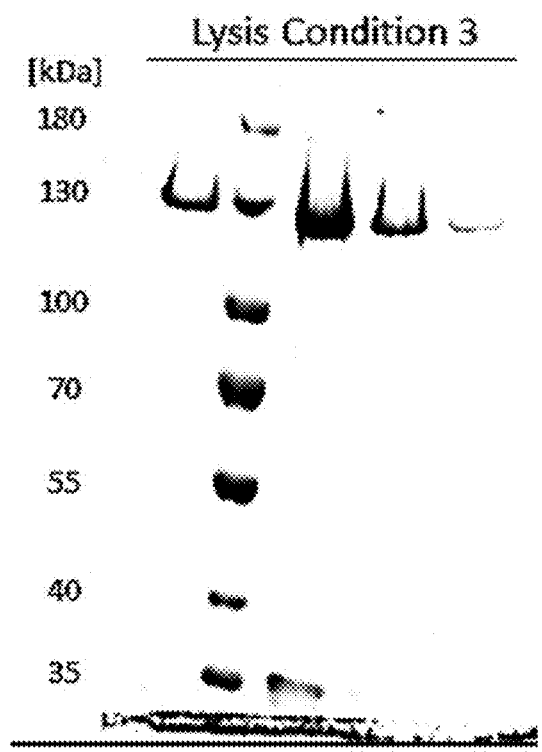
FIG. 13C shows a coomassie Blue stained gel of lysis condition 3 of Argonaute (SEQ ID NO: 190).
Figure 13D:
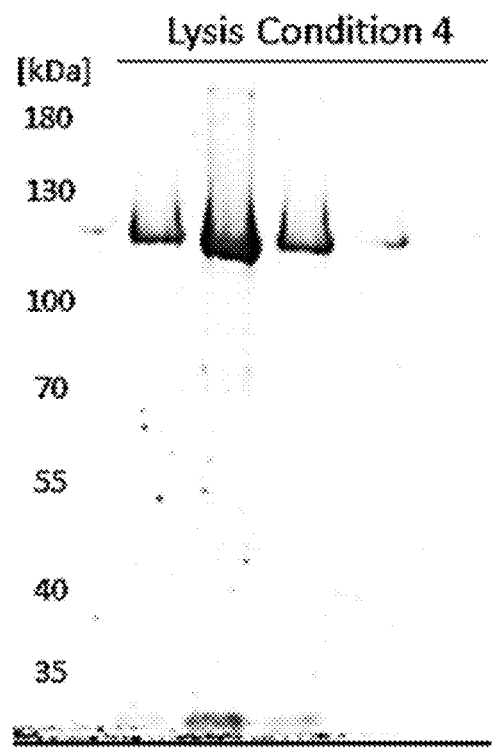
FIG. 13D shows a coomassie Blue stained gel of lysis condition 4 of Argonaute (SEQ ID NO: 190).
Figure 13E:
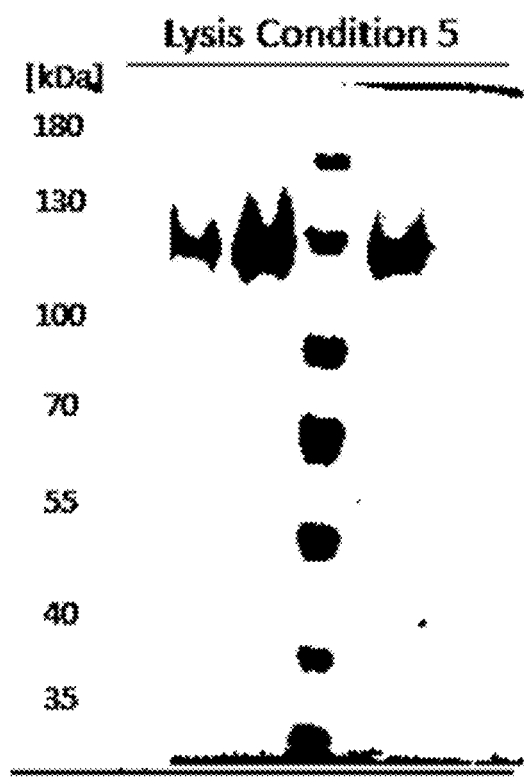
FIG. 13E shows a coomassie Blue stained gel of lysis condition 5 of Argonaute (SEQ ID NO: 190).
Figure 13F:
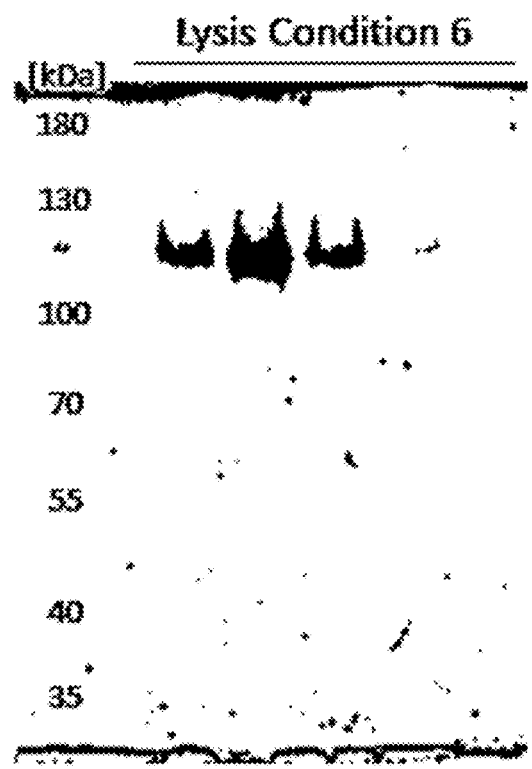
FIG. 13F shows a coomassie Blue stained gel of lysis condition 6 of Argonaute (SEQ ID NO: 190).

| Lysis Condition | Reagents |
|---|---|
| 1<br>FIG. 13A | 50 mM Tris/HCl pH 7.5<br>500 mM NaCl<br>5% Glycerol<br>1 mg/mL Lysozyme<br>100 μg/mL DNase I<br>5 mM β-Mercaptoethanol<br>1 mM PMSF |
| 2<br>FIG. 13B | 50 mM Tris/HCl pH 7.5<br>500 mM NaCl<br>5% Glycerol<br>1 mg/mL Lysozyme<br>1 μg/mL DNase I<br>5 mM β-Mercaptoethanol<br>1 mM PMSF |
| 3<br>FIG. 13C | 50 mM Tris/HCl pH 7.5<br>500 mM NaCl<br>5% Glycerol<br>1 mg/mL Lysozyme<br>Benzonase (1:10000)<br>5 mM β-Mercaptoethanol<br>1 mM PMSF |
| 4<br>FIG. 13D | 50 mM Tris/HCl pH 7.5<br>500 mM NaCl<br>5% Glycerol<br>1 mg/mL Lysozyme<br>Benzonase (1:20000)<br>5 mM β-Mercaptoethanol<br>1 mM PMSF |
| 5<br>FIG. 13E | B-PER Lysis Buffer<br>1M NaCl<br>5 mM β-Mercaptoethanol<br>1 mM PMSF<br>500 μg/mL Lysozyme<br>Sonication: no nucleases<br>20% Amplitude<br>(5 sec ON, 1 sec OFF)<br>2 min; 2 cycles |
| 6<br>FIG. 13F | 50 mM Tris/HCl pH 7.5<br>500 mM NaCl<br>5% Glycerol<br>5 mM β-Mercaptoethanol<br>1 mM PMSF<br>Sonication: no nucleases<br>35% Amplitude<br>(5 sec ON, 1 sec OFF)<br>2 min; 1 cycle |

Example 11: Argonaute Activity Assay

For activity assays, elution fractions containing Argo protein (EF5) were diluted with Buffer I, containing 5 mM β-Mercaptoethanol and 250 mM Imidazole to a final protein concentration of 30 μg/mL. A total of 10 μl protein sample was mixed with 0.25 μM sgDNA or sgRNA in 18.5 μl of reaction buffer (Ago preloading step: 0.3 μg protein, 0.25 μM sgDNA/sgRNA, 20 mM Tris/HCl, 5 mM MnCl2; 250 mM NaCl, 83.3 mM Imidazole, 1.6 mM β-Mercaptoethanol, 1.6% Glycerol). The reaction was incubated at 37° C. for 15 min. After pre-incubation, ssDNA (0.25 04) or dsDNA (100 ng) templates (1 μl) were added and incubated for 1h at 37° C.

AGO protein preps: DNase I or Sonication lysis (Lysis Condition 6)
Elution fraction 4 (EF4): 125 mM Imidazole
Elution fraction 5 (EF5): 250 mM Imidazole
sgDNAs (Table 25):
D1 . . . targeting sgDNA
D2 . . . targeting sgDNA
NT . . . non-targeting sgDNA
Template: 90 nt ssDNA (Table 24)
Expected cleavage products for D1: 66 bp, 24 bp
Expected cleavage products for D2: 69 bp, 21 bp
Final Buffer Concentrations
MnCl2: 5 mM
Tris/HCl, pH 8: 15 mM
NaCl: as indicated
Imidazole: 32.25 Mm (Ef4), 62.5 Mm (Ef5)
Incubation time:
Pre-incubation (AGO+sgDNA): 15 min at 37° C.
Incubation: 1 hour at 37° C.

Figure 14A:
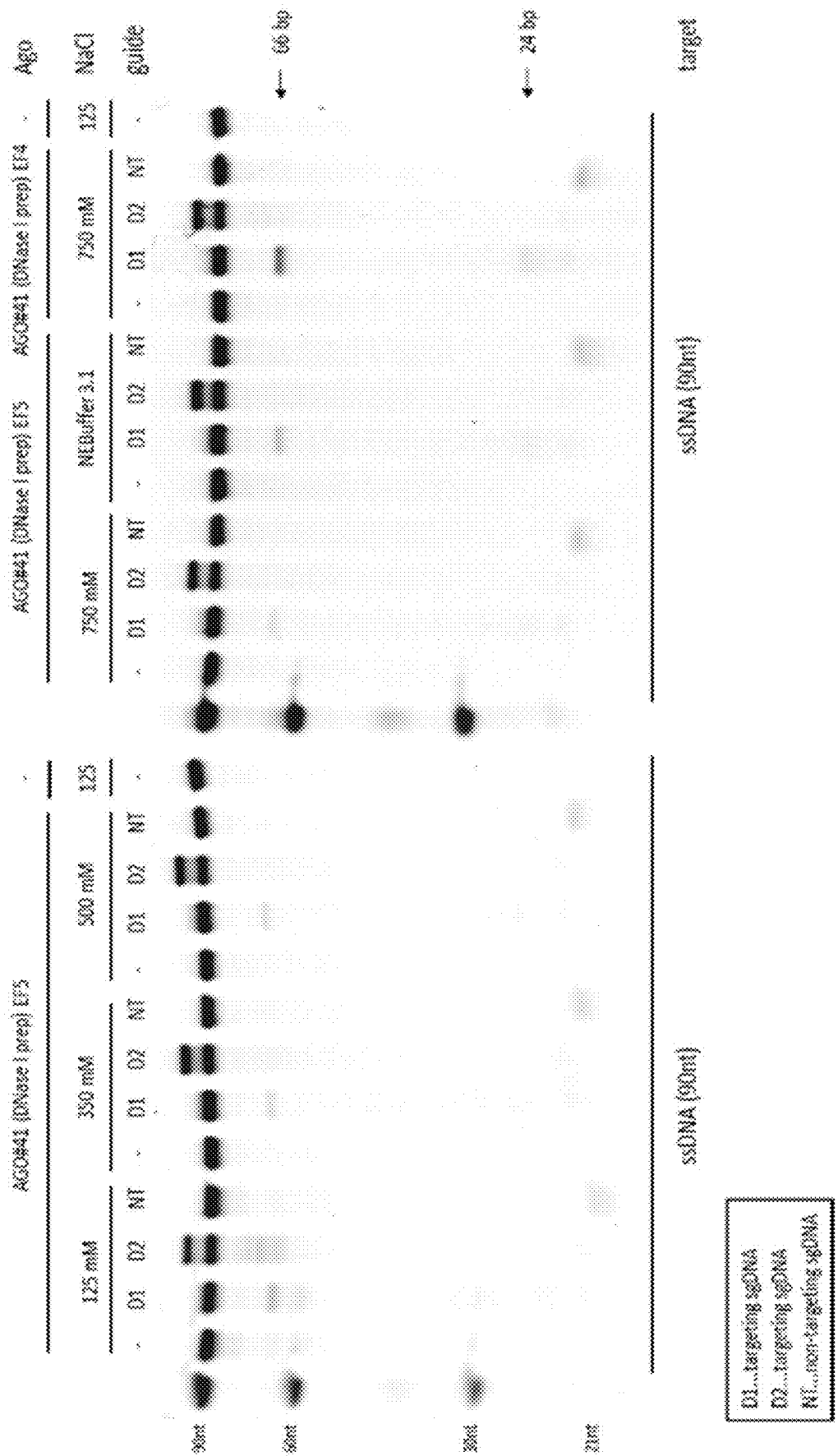
FIG. 14A shows a ssDNA gel stained with SYBR Gold of the ssDNA cleavage assay utilizing Argonaute (SEQ ID NO: 190) in conjunction with sgDNA (D1, D2, or non-targeting sgDNA (NT)), Table 25, under different concentrations of NaCl.
Figure 14B:
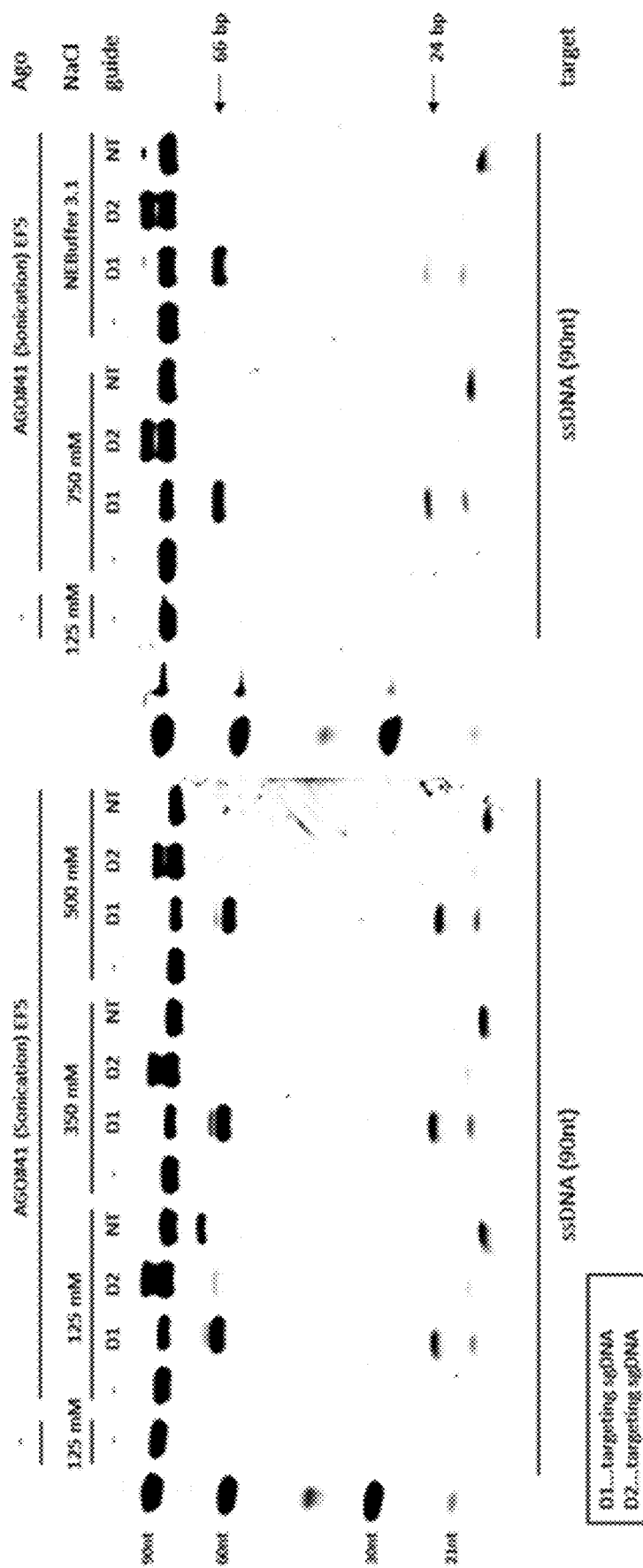
FIG. 14B shows a ssDNA gel stained with SYBR Gold of the ssDNA cleavage assay utilizing sonicated Argonaute (SEQ ID NO: 190) in conjunction with sgDNA (D1, D2, or NT), Table 25, under different concentrations of NaCl.
Figure 14C:
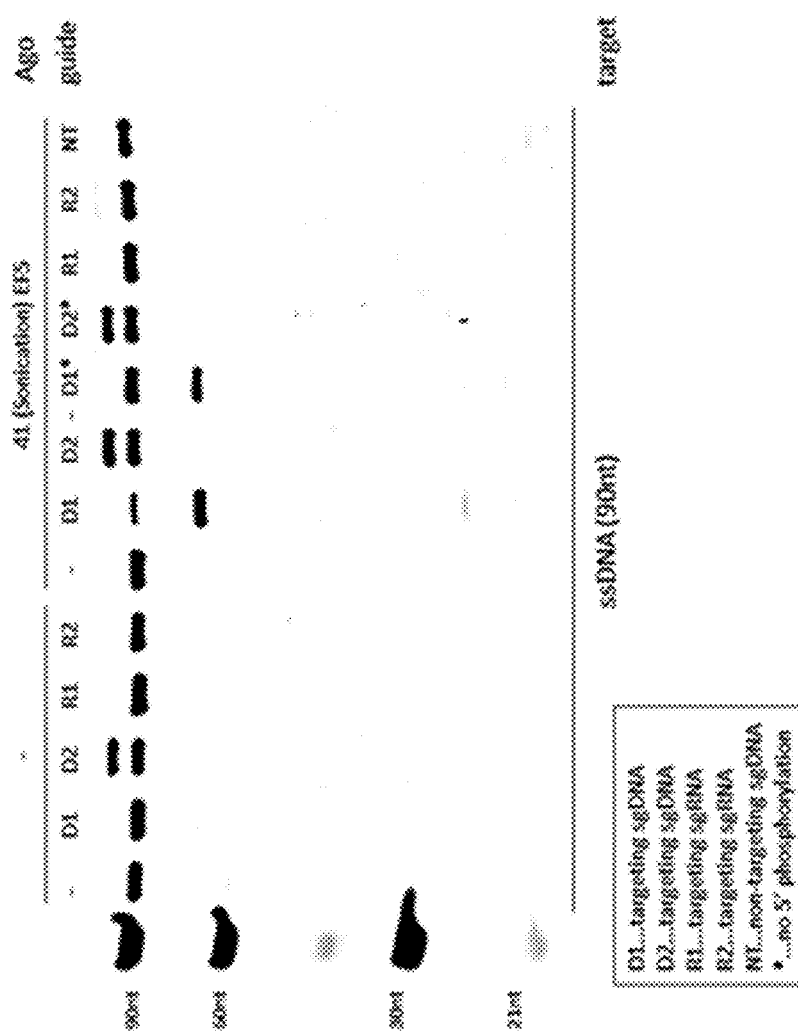
FIG. 14C shows a ssDNA gel stained with SYBR Gold of the ssDNA cleavage assay utilizing sonicated Argonaute (SEQ ID NO: 190) in conjunction with sgDNA (D1, D2, R1, R2, or NT), Table 25, at a concentration of 250 mM NaCl.

To inactivate ssDNA cleavage assay reactions, samples were incubated with TBE urea sample buffer (Biorad) in a 1:1 ratio at 95° C. for 10 min. ssDNA cleavage products were resolved on 15% TBE Urea gels (Invitrogen). Gels were incubated for 15 min with SYBR gold Nucleic Acid Gel Stain (Invitrogen) and visualized using a UVsolo TS Imaging System (Biometra, Analytik Jena). dsDNA cleavage assay reactions were inactivated with Proteinase K solution (20 μh/reaction) (Qiagen) for 20 min at room temperature. Samples were mixed with 6× loading dye (New England Biolabs) before they were resolved on a 1% agarose gel, containing ethidium bromide. As a marker, a 1 kb Generuler Marker (agarose gels) or an in-house prepared ssDNA marker (urea gels) were used, FIG. 14A, FIG. 14B, and FIG. 14C.

Figure 14D:
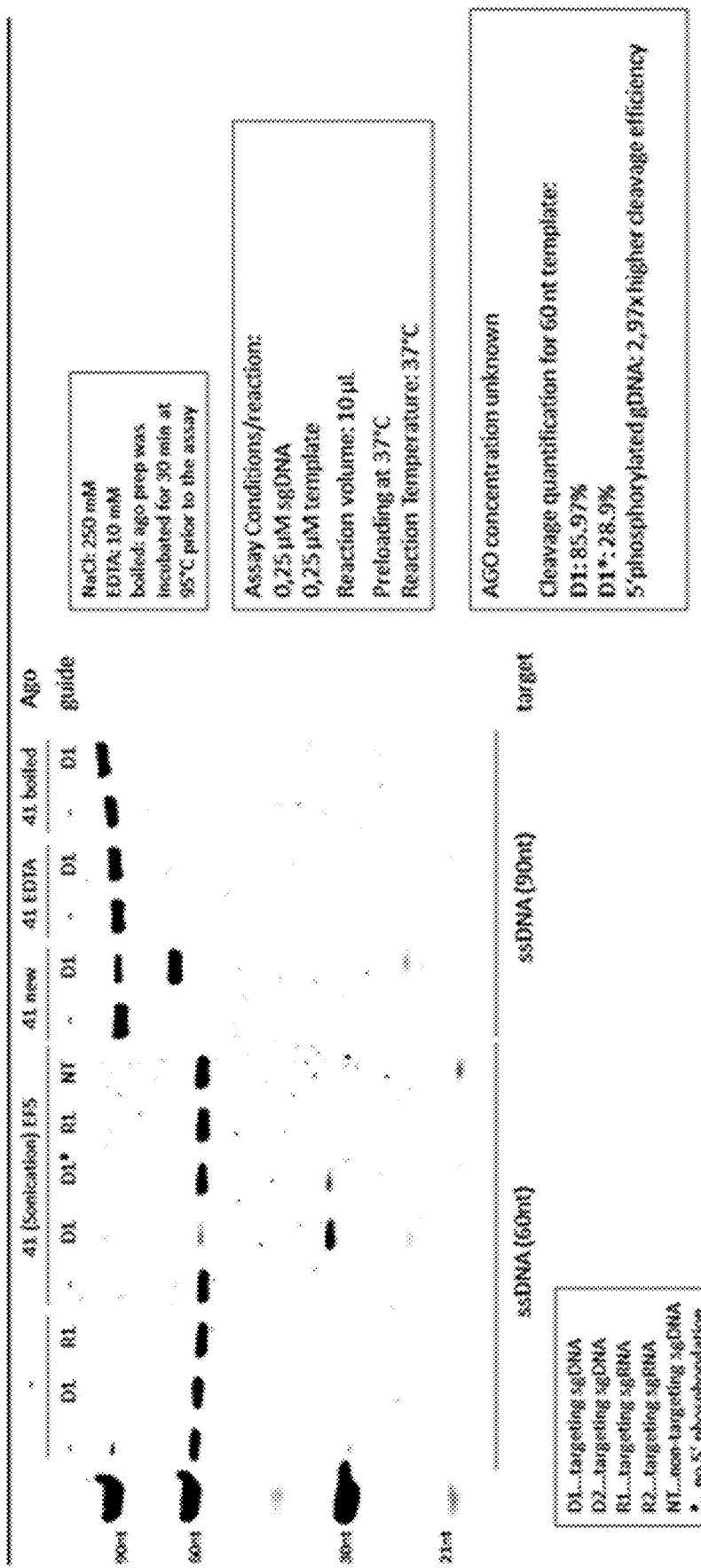
FIG. 14D shows a ssDNA gel stained with SYBR Gold of the ssDNA cleavage assay utilizing sonicated Argonaute (SEQ ID NO: 190) under different treatment conditions comprising a heating step of 95° C. in conjunction with sgDNA (D1, D2, R1, R2, or NT) Table 25.
Figure 15A:
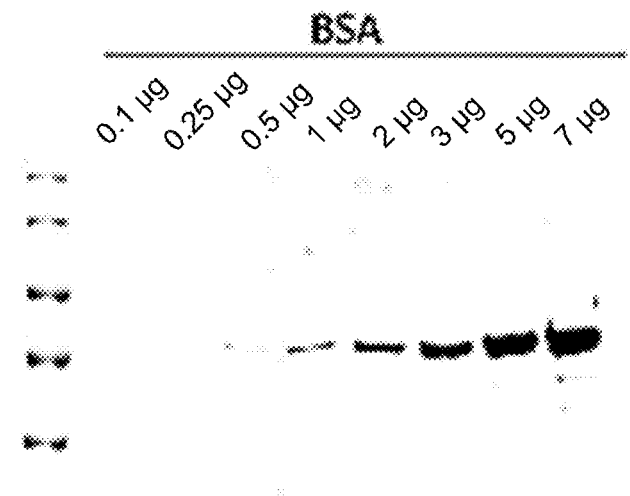
FIG. 15A shows protein quantification standard curve of BSA.
Figure 15B:
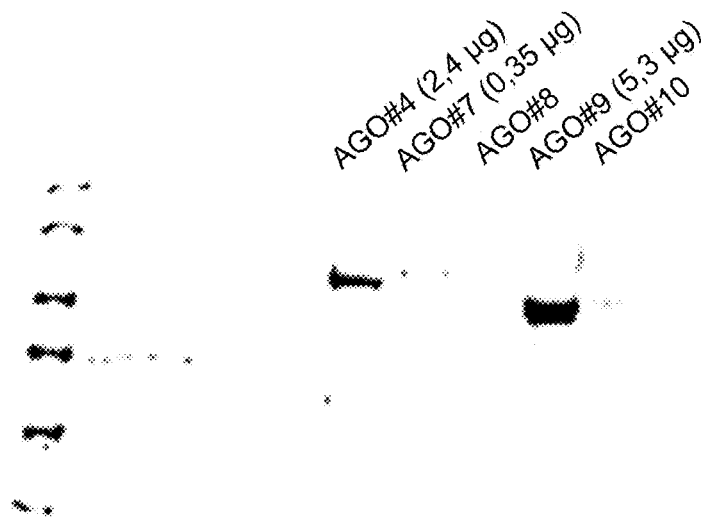
FIG. 15B shows protein quantification of Argo #4, Argo #7, Argo #8, Argo #9, and Argo #10.
Figure 15C:
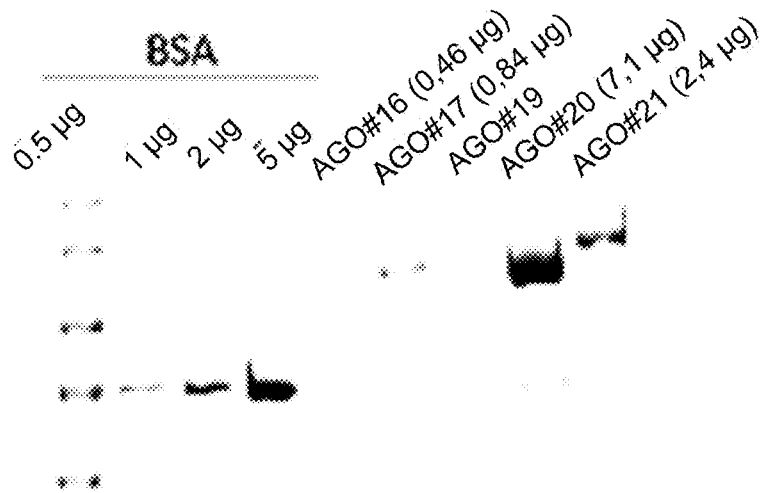
FIG. 15C shows protein quantification of Argo #16, Argo #17, Argo #19, Argo #20, and Argo #21.
Figure 15D:
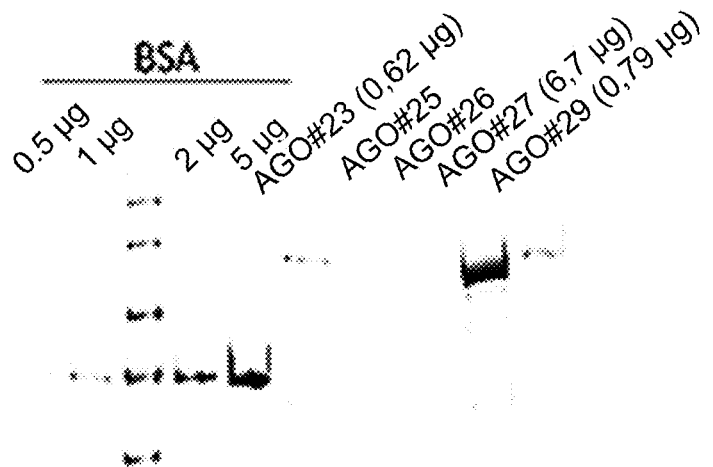
FIG. 15D shows protein quantification of Argo #23, Argo #25, Argo #26, Argo #27, and Argo #29.
Figure 15E:
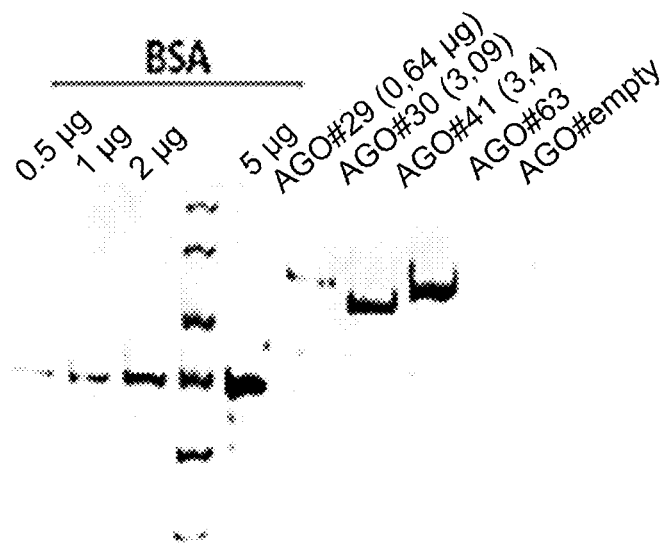
FIG. 15E shows protein quantification of Argo #29, Argo #30, Argo #41, Argo #63, and Empty control.

To determine if ssDNA cleavage occurs at increased temperatures due to nucleic acid unwinding as a result from the heat, Argo prep, was heated to 95° C. for 30 min prior to running of the cleavage assay, FIG. 14D. The undigested plasmid was used as a control to see whether the protein stability is affected by a higher T, FIG. 18. Based on these ssDNA cleavage assays, dsDNA cleavage assays are currently being evaluated and optimized.

Figure 26A:
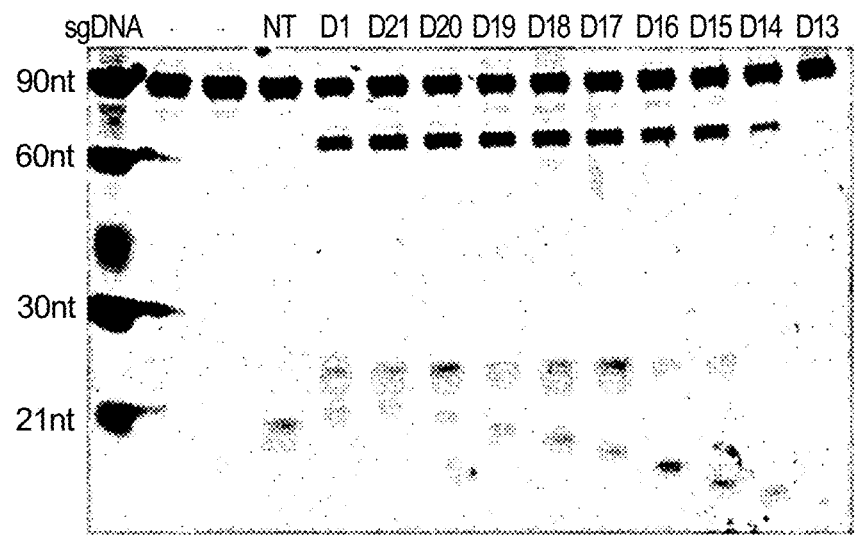
FIG. 26A shows a coomassie Blue stained gel of a ssDNA cleavage assay utilizing truncated guiding polynucleic acids of Table 22.
Figure 26B:
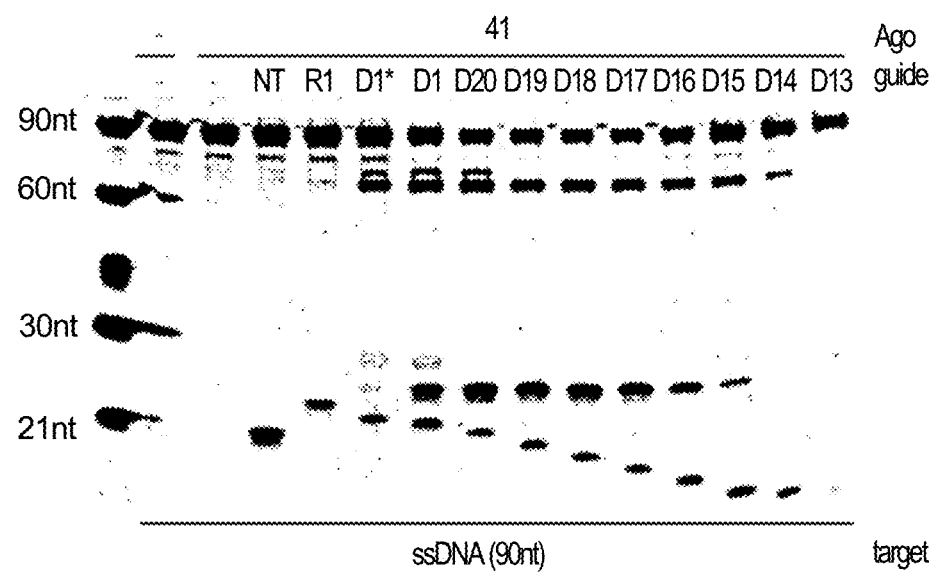
FIG. 26B shows a ssDNA gel stained with SYBR Gold of a ssDNA cleavage assay utilizing truncated guiding polynucleic acids of Table 22, D1* denotes that D1 has no 5' phosphorylation.

To determine Argonaute cutting efficiency utilizing truncated guide polynucleic acids, elution fractions containing Argo protein (EF5) were diluted with Buffer I, containing 5 mM β-Mercaptoethanol and 250 mM Imidazole to a final protein concentration of 30 μg/mL. A total of 10 μl protein sample was mixed with 0.08 μM sgDNA or sgRNA in 30 μl of reaction buffer (protein, truncated sgDNA/sgRNA (Table 22), Tris/HCl, MnCl2; NaCl, Imidazole, β-Mercaptoethanol, and Glycerol). The reaction was incubated at 37° C. for 15 min. After pre-incubation, ssDNA (0.8 µM) template (1 µl) was added and incubated for 1h at 37° C., FIG. 26A and FIG. 26B.

TABLE 22

| Truncated sgDNA | | |
|---|---|---|
| sgDNA No | Sequence | SEQ ID NO |
| sgDNA21 | GCTGCCATCCAGATCGTTATC | 345 |
| sgDNA20 | GCTGCCATCCAGATCGTTAT | 346 |
| sgDNA19 | GCTGCCATCCAGATCGTTA | 347 |
| sgDNA18 | GCTGCCATCCAGATCGTT | 348 |

TABLE 22-continued

| Truncated sgDNA | | |
|---|---|---|
| sgDNA No | Sequence | SEQ ID NO |
| sgDNA17 | GCTGCCATCCAGATCGT | 349 |
| sgDNA16 | GCTGCCATCCAGATCG | 350 |
| sgDNA15 | GCTGCCATCCAGATC | 351 |
| sgDNA14 | GCTGCCATCCAGAT | 352 |
| sgDNA13 | GCTGCCATCCAGA | 353 |

TABLE 23

| | | dsDNA Cleavage Assay |
|---|---|---|
| SEQ ID NO | Sequence ID | DNA Sequence |
| 354 | PCR amplicon-t-GFP | TCAAGCCTCAGACAGTGGTTCAAAGTTTTTTTCTTCCATTTCAGGTGTCGTGACGCCACCATGGAGAGCGACG AGAGCGGCCTGCCCGCCATGGAGATCGAGTGCCGCATCACCGGCACCCTGAACGGCGTGGAGTTCGAGCTGGT GGGCGGCGGAGAGGGCACCCCCGAGCAGGGCCGCATGACCAACAAGATGAAGAGCACCAAAGGCGCCCTGACC TTCAGCCCCTACCTGCTGAGCCACGTGATGGGCTACGGCTTCTACCACTTCGGCACCTACCCCAGCGGCTACG AGAACCCCTTCCTGCACGCCATCAACAACGGCGGCTACACCAACACCCGCATCGAGAAGTACGAGGACGGCGG CGTGCTGCACGTGAGCTTCAGCTACCGCTACGAGGCCGGCCGCGTGATCGGCGACTTCAAGGTGATGGGCACC GGCTTCCCCGAGGACAGCGTGATCTTCACCGACAAGATCATCCGCAGCAACGCCACCGTGGAGCACCTGCACC CCATGGGCGATAACGATCTGGATGGCAGCTTCACCCGCACCTTCAGCCTGCGCGACGGCGGCTACTACAGCTC CGTGGTGGACAGCCACATGCACTTCAAGAGCGCCATCCACCCCAGCATCCTGCAGAACGGGGGCCCCATGTTC GCCTTCCGCCGCGTGGAGGAGGATCACAGCAACACCGAGCTGGGCATCGTGGAGTACCAGCACGCCTTCAAGA CCCCCGGATGCAGATGCCGGTGAAGAATAACTGTGCCTTCTAGTTGCCAGCCATCTGTCCCCATGGGCGATAAC GATCTGTTTGCCCCTCCCCCGTGCCTTCCTTGACCCTGGAAGGTGCCACTCCCACTGTCCTTTCCTAATAAAA TGAGGAAATTGCATCGCATTGTCTGAGTAGGTGTCATTCTATTCTGGGGGGTGGGGTGGGGCAGGACAGCAAG GGGGAGGATTGGGAAGACAATAGCAGGCATGC |
| 355 | PCR amplicon-Kanamycin | GAAAAACTCATCGAGCATCAAATGAAACTGCAATTTATTCATATCAGGATTATCAATACCATATTTTTGAAAA AGCCGTTTCTGTAATGAAGGAGAAAACTCACCGAGGCAGTTCCATAGGATGGCAAGATCCTGGTATCGGTCTG CGATTCCGACTCGTCCAACATCAATACAACCTATTAATTTCCCCTCGTCAAAAATAAGGTTATCAAGTGAGAA ATCACCATGAGTGACGACTGAATCCGGTGAGAATGGCAAAAGTTTATGCATTTCTTTCCAGACTTGTTCAACA GGCCAGCCATTACGCTCGTCATCAAAATCACTCGCATCAACCAAACCGTTATTCATTCGTGATTGCGCCTGAG CGAGACGAAATACGCGATCGCTGTTAAAAGGACAATTACAAACAGGAATCGAATGCAACCGGCGCAGGAACAC TGCCAGCGCATCAACAATATTTTCACCTGAATCAGGATATTCTTCTAATACCTGGAATGCTGTTTTCCCGGGG ATCGCAGTGGTGAGTAACCATGCATCATCAGGAGTACGGATAAAATGCTTGATGGTCGGAAGAGGCATAAATT CCGTCAGCCAGTTTAGTCTGACCATCTCATCTGTAACATCATTGGCAACGCTACCTTTGCCATGTTTCAGAAA CAACTCTGGCGCATCGGGCTTCCCATACAATCGATAGATTGTCGCACCTGATTGCCCGACATTATCGCGAGCC CATTTATACCCATATAAATCAGCATCCATGTTGGAATTTAATCGCGGCCTAGAGCAAGACGTTTCCCGTTGAA TATGGCTCAT |
| 356 | Linearized Plasmid #89 | AGCCTGAATGGCGAATGGGACGCGCCCTGTAGCGGCGCATTAAGCGCGGCGGGTGTGGTGGTTACGCGCAGCG TGACCGCTACACTTGCCAGCGCCCTAGCGCCCGCTCCTTTCGCTTTCTTCCCTTCCTTTCTCGCCACGTTCGC CGGCTTTCCCCGTCAAGCTCTAAATCGGGGGCTCCCTTTAGGGTTCCGATTTAGTGCTTTACGGCACCTCGAC CCCAAAAAACTTGATTAGGGTGATGGTTCACGTAGTGGGCCATCGCCCTGATAGACGGTTTTTCGCCCTTTGA CGTTGGAGTCCACGTTCTTTAATAGTGGACTCTTGTTCCAAACTGGAACAACACTCAACCCTATCTCGGTCTA TTCTTTTGATTTATAACAGTTAATTAAAGGGAACAAAAGCTGGCATGTACCGTTCGTATAGCATACATTATCGAA CGGTACGCTCCAATTCGCCCTTTAATTAACTGTTCAACTTTCACCATAATGAAATAAGATCACTACCGGGCG TATTTTTTGAGTTGTCGAGATTTTCAGGAGCTAAGGAAGCTAAAATGGAGAAAAAAATCACTGGATATACCAC CGGATACTGCGATGAGTGGCAGGGCGGGGCGTAATTTTTTTAAGGCAGTTATTGGTGCCCTTAAACGCCTGGT TGCTACGCCTGAATAAGTGATAATAAGCGGATGAATGGCAGAAATTCGAAAGCAAATTCGACCCGGTCGTCGG TTCAGGGCAGGGTCGTTAAATAGCCGCTTATGTCTATTGCTGGTTTACCGGTTTATTGACTACCGGAAGCAGT GTGACCGTGTGCTTCTCAAATGCCTGAGGCCAGTTTGCTCAGGCTCTCCCCGTGGAGGTAATAATTGACGATA TGATCCTTTTTTTCTGATCAAAAAGGATCTAGGTGAAGATCCTTTTTGATAATCTCATGACCAAAATCCCTTA ACGTGAGTTTTCGTTCCACTGAGCGTCAGACCCCGTAGAAAAGATCAAAGGATCTTCTTGAGATCCTTTTTTT CTGCGCGTAATCTGCTGCTTGCAAACAAAAAAACCACCGCTACCAGCGGTGGTTTGTTTGCCGGATCAAGAGC TACCAACTCTTTTTCCGAAGGTAACTGGCTTCAGCAGAGCGCAGATACCAAATACTGTTCTTCTAGTGTAGCC GTAGTTAGGCCACCACTTCAAGAACTCTGTAGCACCGCCTACATACCTCGCTCTGCTAATCCTGTTACCAGTG GCTGCTGCCAGTGGCGATAAGTCGTGTCTTACCGGGTTGGACTCAAGACGATAGTTACCGGATAAGGCGCAGC GGTCGGGCTGAACGGGGGGTTCGTGCACACAGCCCAGCTTGGAGCGAACGACCTACACCGAACTGAGATACCT ACAGCGTGAGCTATGAGAAAGCGCCACGCTTCCCGAAGGGAGAAAGGCGGACAGGTATCCGGTAAGCGGCAGG GTCGGAACAGGAGAGCGCACGAGGGAGCTTCCAGGGGGAAACGCCTGGTATCTTTATAGTCCTGTCGGGTTTC GCCACCTCTGACTTGAGCGTCGATTTTTGTGATGCTCGTCAGGGGGGCGGAGCCTATGGAAAAACGCCAGCAA CGCGGCCTTTTTACGGTTCCTGGCCTTTTGCTGGCCTTTTGCTCACATGTTCTTTCCTGCGTTATCCCCTGAT TCTGTGGATAACCGTATTACCGCCTTTGAGTGAGCTGATACCGCTCGCCGCAGCCGAACGACCGAGCGCAGCG AGTCAGTGAGCGAGGAAGCGGAAGAGCGCCCAATACGCAAACCGCCTCTCCCCGCGCGTTGGCCGATTCATTA ATGCAGCTGGCACGACAGGTTTCCCGACTGGAAAGCGGGCAGTGAGCGCAACGCAATTAATGTGAGTTAGCTC |

TABLE 23-continued dsDNA Cleavage Assay

| SEQ ID NO | Sequence ID | DNA Sequence |
|---|---|---|
| | | ACTCATTAGGCACCCCAGGCTTTACACTTTATGCTCCCGGCTCGTATGTTGTGTGGAATTGTGAGCGGATAAC
AATTTCACACAGGAAACAGCTATGACCATGATTACGCCAAGCGCGCAATTAACCCTCACTAAAGGGAACAAAA
GCTGGGTACCGGGCCCCCCCTCGAGGTCGACGGTATCGATAAGCTTGATATCCACTGTGGAATTCGCCCTTTC
AAGCCTCAGACAGTGGTTCAAAGTTTTTTTCTTCCATTTCAGGTGTCGTGACGCCACCATGGAGAGCGACGAG
AGCGGCCTGCCCGCCATGGAGATCGAGTGCCGCATCACCGGCACCCTGAACGGCGTGGAGTTCGAGCTGGTGG
GCGGCGGAGAGGGCACCCCCGAGCAGGGCCGCATGACCAACAAGATGAAGAGCACCAAAGGCGCCCTGACCTT
CAGCCCCTACCTGCTGAGCCACGTGATGGGCTACGGCTTCTACCACTTCGGCACCTACCCCAGCGGCTACGAG
AACCCCTTCCTGCACGCCATCAACAACGGCGGCTACACCAACACCCGCATCGAGAAGTACGAGGACGGCGGCG
TGCTGCACGTGAGCTTCAGCTACCGCTACGAGGCCGGCCGCGTGATCGGCGACTTCAAGGTGATGGGCACCGG
CTTCCCCGAGGACAGCGTGATCTTCACCGACAAGATCATCCGCAGCAACGCCACCGTGGAGCACCTGCACCCC
ATGGGCGATAACGATCTGGATGGCAGCTTCACCCGCACCTTCAGCCTGCGCGACGGCGGCTACTACAGCTCCG
TGGTGGACAGCCACATGCACTTCAAGAGCGCCATCCACCCCAGCATCCTGCAGAACGGGGGCCCCATGTTCGC
CTTCCGCCGCGTGGAGGAGGATCACAGCAACACCG |
| | | AGCTGGGCATCGTGGAGTACCAGCACGCCTTCAAGACCCCGGATGCAGATGCCGGTGAAGAATAACTGTGCCT
TCTAGTTGCCAGCCATCTGTCCCCATGGGCGATAACGATCTGTTTGCCCCTCCCCCGTGCCTTCCTTGACCCT
GGAAGGTGCCACTCCCACTGTCCTTTCCTAATAAAATGAGGAAATTGCATCGCATTGTCTGAGTAGGTGTCAT
TCTATTCTGGGGGGTGGGGTGGGGCAGGACAGCAAGGGGGAGGATTGGGAAGACAATAGCAGGCATGCAAGGG
CGAATTCCACATTGGGCTGCAGCCCGGGGGATCCACTAGTTCTAGAGCGGCCGCACCGCGGGAGCTCCAATTC
GCCCTATAGTGAGTCGTATTACGCGCGCTCACTGGCCGTCGTTTTACAACGTCGTGACTGGGAAAACCCTGGC
GTTACCCAACTTAATCGCCTTGCAGCACATCCCCCTTTCGCCAGCTGGCGTAATAGCGAAGAGGCCCGCACCG
ATTAAATTTTGGTCATGAGATTATCAAAAAGGATCTTCACCTAGATCCTTTTAAATTAAAAATGAAGTTTTAA
ATCAATCTAAAGTATATATGAGTAAACTTGGTCTGACAGTCAGAAGAACTCGTCAAGAAGGCGATAGAAGGCG
ATGCGCTGCGAATCGGGAGCGGCGATACCGTAAAGCACGAGGAAGCGGTCAGCCCATTCGCCGCCAAGTTCTT
CAGCAATATCACGGGTAGCCAACGCTATGTCCTGATAGCGGTCCGCCACACCCAGCCGGCCACAGTCGATGAA
TCCAGAAAAGCGGCCATTTTCCACCATGATATTCGGCAAGCAGGCATCGCCATGGGTCACGACGAGATCCTCG
CCGTCGGGCATGCTCGCCTTGAGCCTGGCGAACAGTTCGGCTGGCGCGAGCCCCTGATGTTCTTCGTCCAGAT
CATCCTGATCGACAAGACCGGCTTCCATCCGAGTACGTGCTCGCTCGATGCGATGTTTCGCTTGGTGGTCGAA
TGGGCAGGTAGCCGGATCAAGCGTATGCAGCCGCCGCATTGCATCAGCCATGATGGATACTTTCTCGGCAGGA
GCAAGGTGAGATGACAGGAGATCCTGCCCCGGCACTTCGCCCAATAGCAGCCAGTCCCTTCCCGCTTCAGTGA
CAACGTCGAGCACAGCTGCGCAAGGAACGCCCGTCGTGGCCAGCCACGATAGCCGCGCTGCCTCGTCTTGCAG
TTCATTCAGGGCACCGGACAGGTCGGTCTTGACAAAAAGAACCGGGCGCCCCTGCGCTGACAGCCGGAACACG
GCGGCATCAGAGCAGCCGATTGTCTGTTGTGCCCAGTCATAGCCGAATAGCCTCTCCACCCAAGCGGCCGGAG
AACCTGCGTGCAATCCATCTTGTTCAATCATTAGTGTCCTTACCAATGCTTAATCAGTGAGGCACCTATCTCA
GCGATCTGTCTATTTCGTTCATCCATAGTTGCCTGACTCCCCGTCGTGTAGATAACTACGATACGGGAGGGCT
TACCATCTGGCCCCAGTGCTGCAATGATACCGCGAGACCCACGCTCACCGGCTCCAGATTTATCAGCAATAAA
CCAGCCAGCCGGAAGGGCCGAGCGCAGAAGTGGTCCTGCAACTTTATCCGCCTCCATCCAGTCTATTAATTGT
TGCCGGGAAGCTAGAGTAAGTAGTTCGCCAGTTAATAGTTTGCGCAACGTTGTTGCCATTGCTACAGGCATCG
TGGTGTCACGCTCGTCGTTTGGTATGGCTTCATTCAGCTCCGGTTCCCAACGATCAAGGCGAGTTACATGATC
CCCCATGTTGTGCAAAAAAGCGGTTAGCTCCTTCGGTCCTCCGATCGTTGTCAGAAGTAAGTTGGCCGCAGTG
TTATCACTCATGGTTATGGCAGCACTGCATAATTCTCTTACTGTCATGCCATCCGTAAGATGCTTTTCTGTGA
CTGGTGAGTACTCAACCAAGTCATTCTGAGAATAGTGTATGCGGCGACCGAGTTGCTCTTGCCCGGCGTCAAT
ACGGGATAATACCGCGCCACATAGCAGAACTTTAAAAGTGCTCATCATTGGAAAACGTTCTTCGGGGCGAAAA
CTCTCAAGGATCTTACCGCTGTTGAGATCCAGTTCGATGTAACCCACTCGTGCACCCAACTGATCTTCAGCAT
CTTTTACTTTCACCAGCGTTTCTGGGTGAGCAAAAACAGGAAGGCAAAATGCCGCAAAAAAGGGAATAAGGGC
GACACGGAAATGTTGAATACTCATACTCTTCCTTTTTCAATATTATTGAAGCATTTATCAGGGTTATTGTCTC
ATGAGCGGATACATATTTGAATGTATTTAGAAAAATAAACAAATAGGGGTTCCGCGCACATTTCCCCGAAAAG
TGCCACCTTAATCGCCCTTCCCAACAGTTGCGC |

TABLE 24 ssDNA Cleavage Assay

| SEQ ID NO | Sequence ID | DNA Sequence |
|---|---|---|
| 357 | Template (90 nt) | TGCACCCCATGGGCGATAACGATCTGGATGGCAGCTTCACCCGCACCTTC
AGCCTGCGCGACGGCGGCTACTACAGCTCCGTGGTGGACA |
| 358 | Template (60 nt) | TGCACCCCATGGGCGATAACGATCTGGATGGCAGCTTCACCCGCACCTTC
AGCCTGCGCG |

TABLE 25 sqDNA/sqRNA

| SEQ ID NO | Sequence ID | Nucleotide Sequence |
|---|---|---|
| 359 | sgDNA 1 5'phosphorylated | GCTGCCATCCAGATCGTTATC |
| 360 | sgDNA 1* unphosphorylated | GCTGCCATCCAGATCGTTATC |
| 361 | sgRNA 1 5'phosphorylated | GCUGCCAUCCAGAUCGUUAUC |
| 362 | NT gDNA 5'phosphorylated | CCCGAATCTCTATCGTGCGG |
| 363 | sgDNA21 5'phosphorylated | GCTGCCATCCAGATCGTTATC |
| 364 | sgDNA20 5'phosphorylated | GCTGCCATCCAGATCGTTAT |
| 365 | sgDNA19 5'phosphorylated | GCTGCCATCCAGATCGTTA |
| 366 | sgDNA18 5'phosphorylated | GCTGCCATCCAGATCGTT |
| 367 | sgDNA17 5'phosphorylated | GCTGCCATCCAGATCGT |
| 368 | sgDNA16 5'phosphorylated | GCTGCCATCCAGATCG |
| 369 | sgDNA15 5'phosphorylated | GCTGCCATCCAGATC |
| 370 | sgDNA14 5'phosphorylated | GCTGCCATCCAGAT |
| 371 | sgDNA13 5'phosphorylated | GCTGCCATCCAGA |
| 372 | sgDNA Kan 1 5'phosphorylated | CTATTAATTTCCCCTCGTCAA |
| 373 | sgDNA Kan 2 5'phosphorylated | TCTCACTTGATAACCTTATTT |
| 374 | sgDNA Kan 3 5'phosphorylated | GATCGCAGTGGTGAGTAACCA |
| 375 | sgDNA Kan 4 5'phosphorylated | GGAAGCCCGATGCGCCAGAGT |
| 376 | sgDNA Kan 5 5'phosphorylated | CCTGATGATGCATGGTTACTC |

Example 12: Mammalian Cell DNA Cutting Assay

Figure 18:
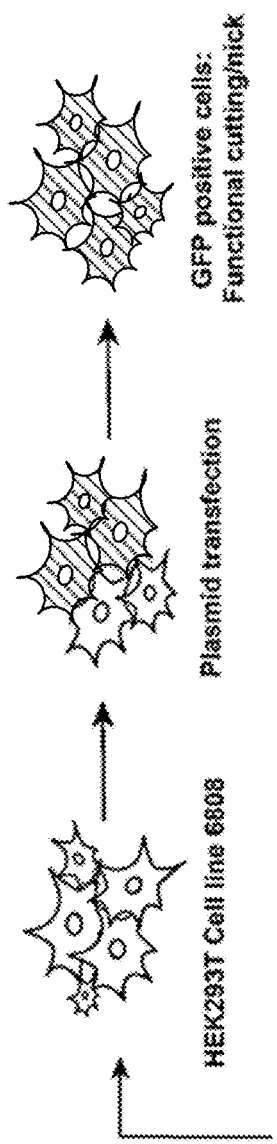
FIG. 18 shows a schematic of the 6808 cell assay.

Split fluorescence protein (FP) systems may be used as protein tagging tools in visualization of protein localization in living cells. In this assay a split fluorescence protein system is used to assess DNA cutting activity of different proteins/constructs. An overview of the assay is shown in FIG. 18. Briefly, a cell line was constructed with a frameshift within a fluorescent protein which may be repaired by non-homologous end joining, repaired cells then display fluorescence. In the self-complementing split $GFP_{1-10/11}$ systems, two fragments ($G_{1-10}$ and $G_{11}$) can associate by themselves to form a functional GFP signal. A study by Feng et al (2017) showed that the insertion of a 96 bp linker between $G_{1-10}$ and $G_{11}$ minimally affects the fluorescence of GFP signal. Therefore, we deleted 2 bps of the linker to frameshift the linker and $GFP_{11}$ fragment, so that the GFP signal was turned off. Different target sites may be selected within the 94 bp linker for DNA cutting. If the linker is cut or nicked insertions or deletions from non-homologous end joining repair, or from homology directed repair, can make the linker and $GFP_{11}$ in-frame and GFP signal can be detected. The sequence of the $GFP_{1-10/11}$ system used was engineered from the sfGFP reported previously (Cabantous, S., Terwilliger, T. C., Waldo, G. S. (2005) Protein tagging and detection with engineered self-assembling fragments of green fluorescent protein. Nat Biotechnol. 23, 102-7).

This construct was used to make a stable mammalian cell line, 6808. An SFFV promoter was used to control the reporter protein expression and mCherry was used as an expression marker to represent the expression of the $GFP_{1-10/11}$ system with inserted 94_linker. For generation of lentivirus, HEK293T cells were transiently transfected the pHR constructs, pCMV-dR8.91, and pMD2.G at a ratio of 9:8:1, respectively. Viral supernatant was collected 72 h post-transfection, passed through a 0.45 μm filter, and concentrated 10× using the Lenti-X Concentrator (Clontech) by incubating overnight at 4° C.

Figure 19:
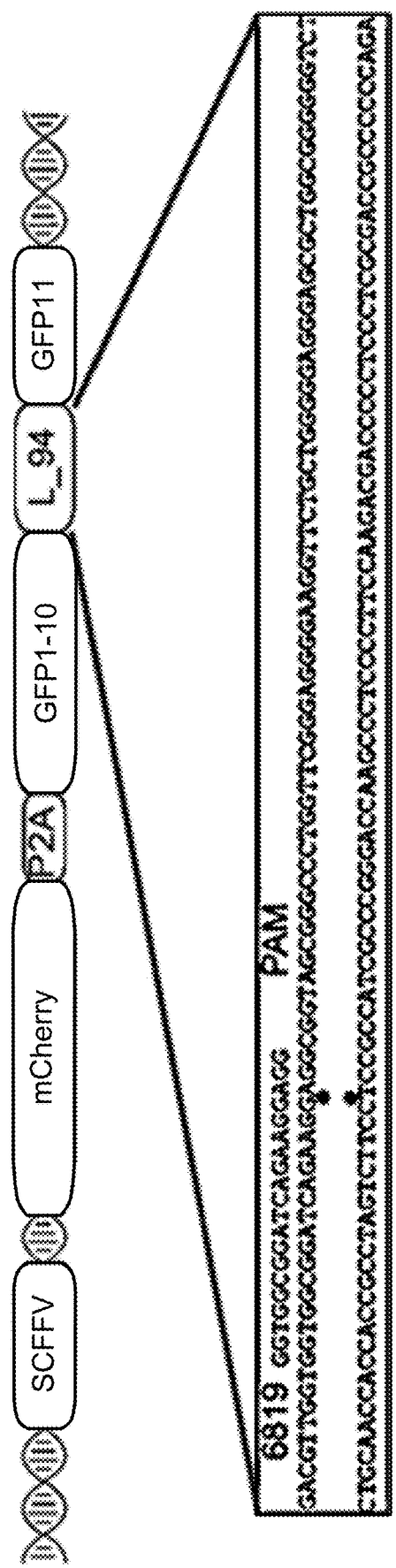
FIG. 19 shows an example of a possible architecture of a split fluorescent reporter for a DNA cutting/nicking assay. Location of guide DNAs is also included 6819, 6821, sg_02, sg_03, sg_01 relative to the architecture.
Figure 20:
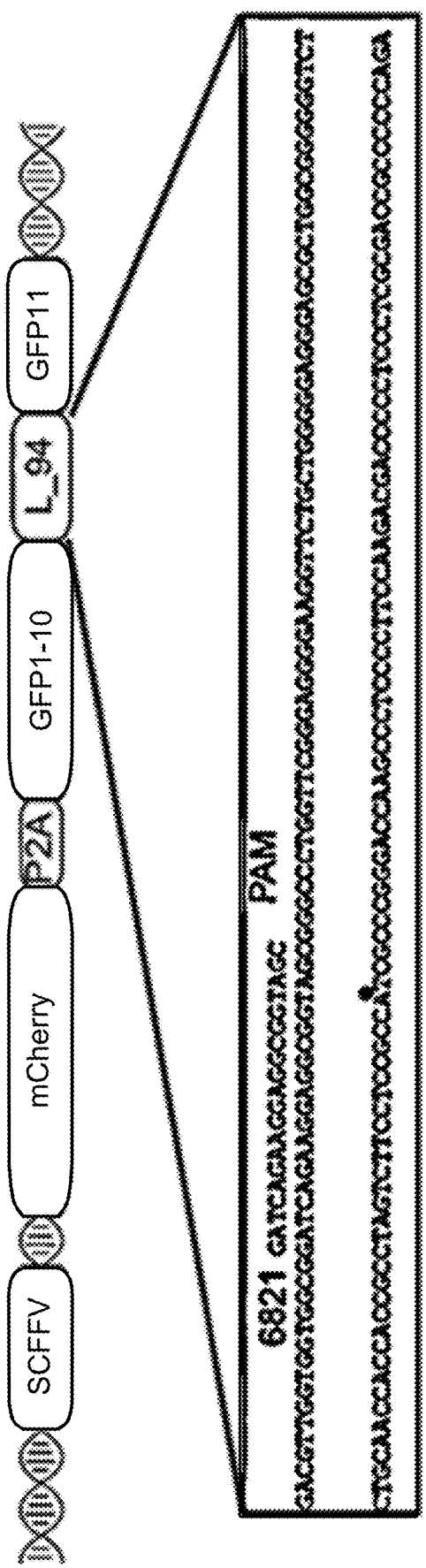
FIG. 20 shows an example of a possible architecture of a split fluorescent reporter for a DNA cutting/nicking assay. Location of guide DNAs is also included 6819, 6821, sg_02, sg_03, sg_01 relative to the architecture.
Figure 21:
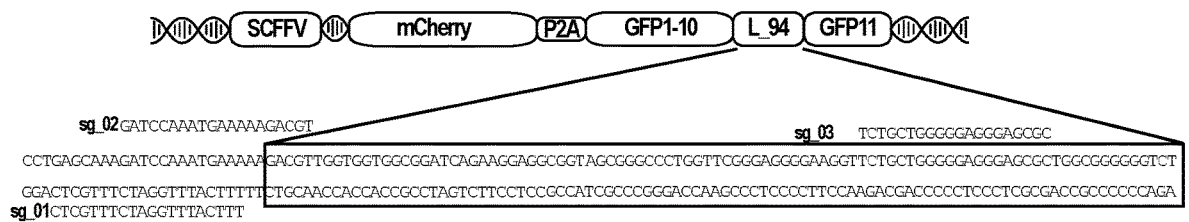
FIG. 21 shows an example of a possible architecture of a split fluorescent reporter for a DNA cutting/nicking assay. Location of guide DNAs is also included 6819, 6821, sg_02, sg_03, sg_01 relative to the architecture.
Figures 22G, 22H, 22I:
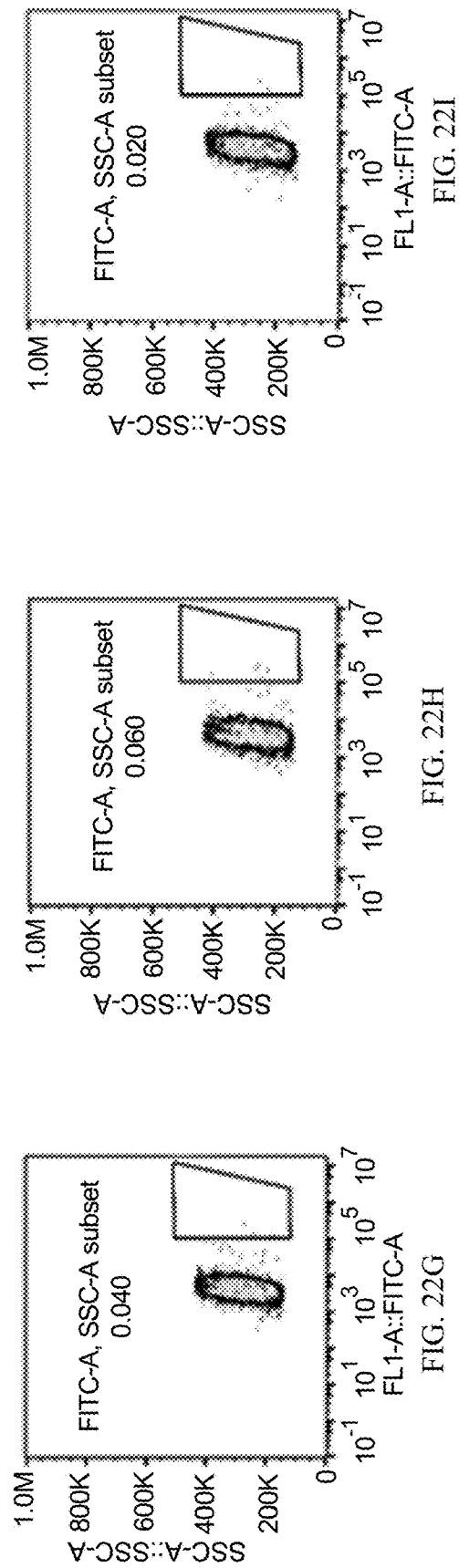
FIG. 22G shows a negative control experiment performed using 6808 cells, Cas9n and a non-targeting guide RNA.
FIG. 22H shows a negative control experiment performed using 6808 cells, Cas9, a non-targeting guide RNA and a single-stranded oligodeoxynucleotide donor.
FIG. 22I shows a negative control experiment performed using 6808 cells, nCas9, a non targeting guide RNA and a single-stranded oligodeoxynucleotide donor.
Figure 35:
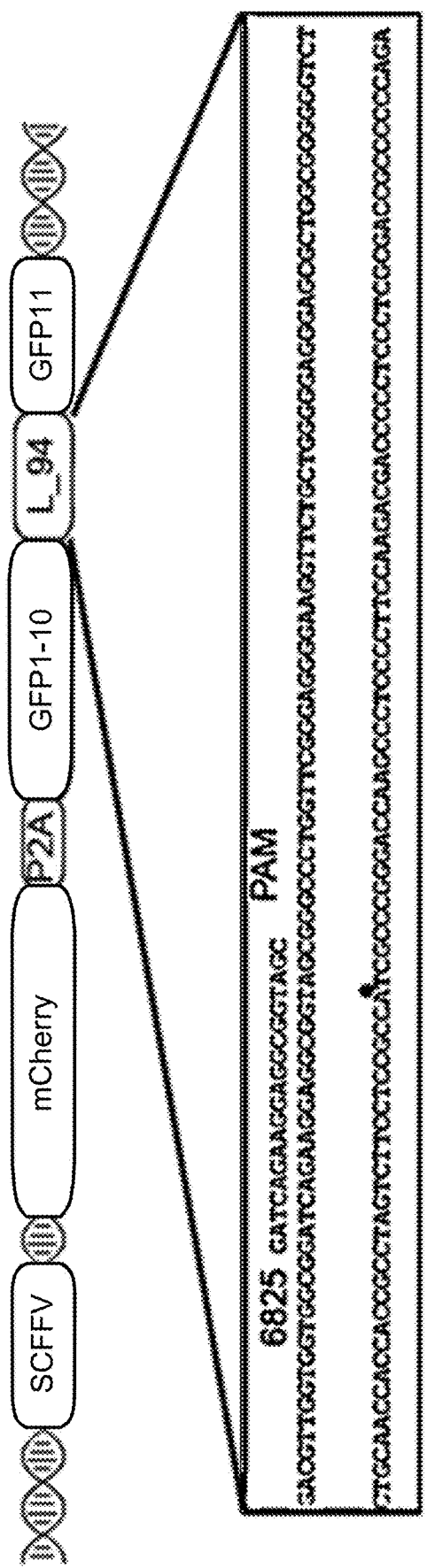
FIG. 35 shows an example of a possible architecture of a split fluorescent reporter for a DNA cutting/nicking assay. Location of guide DNAs is also included 68 25 relative to the architecture.

The 6808 reporter cell line was generated by transducing HEK293T cells with lentivirus expressing the above described architecture, examples of this architecture are also shown in FIGS. 19-21 and in FIG. 35. Single cells were sorted by fluorescence activated cell sorting (FACS) using a BD FACS Aria2 for mCherry marker expression to identified transformed cells.

The 6808 reporter cell line was validated using a Cas9 system to target the 94_linker. 6808 cells were seeded at a density of $1\times10^5$ per well in 12-well plates per well. For transient transfection of cutting and nick experiments, cells were transfected 1 day after seeding with 1.5 μg total of plasmid (sgRNA and Cas9 or Cas9n are on the same plasmid) per well using TransITLT1 transfection reagent (Minis) at a ratio of 6 μL transfection reagent for the 1.5 μg plasmid. Transfected cells were collected after 72h transfection to analyze the GFP expression. To analyze GFP expression, cells were dissociated using 0.05% Trypsin EDTA (Life Technologies) and analyzed by flow cytometry on a BD LSRII. Flow cytometry data was analyzed using FlowJo. 10,000 viable cells were analyzed for each sample. Selected sequences are provided in Table 26.

Figure 23:
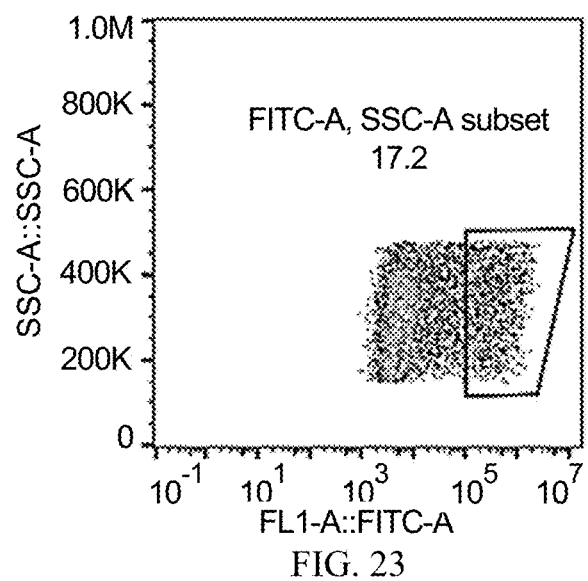
FIG. 23 shows a positive control experiment performed using 6808 cells, Cas9 and a guide RNA targeting the 94_linker.
Figure 24:
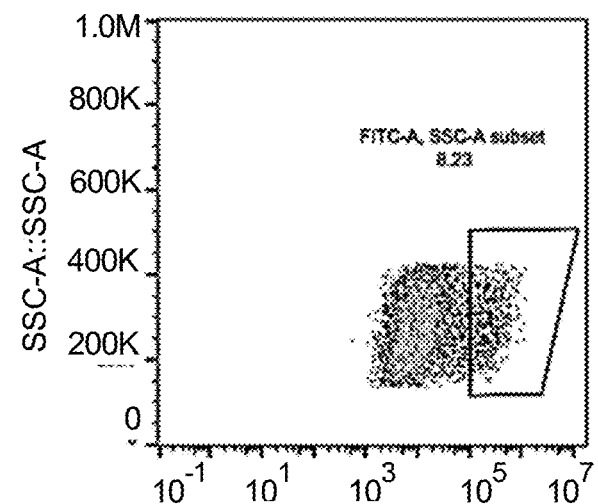
FIG. 24 shows a positive control experiment performed using 6808 cells, nCas9 and a guide RNA targeting the 94_linker.
Figures 25A, 25B:
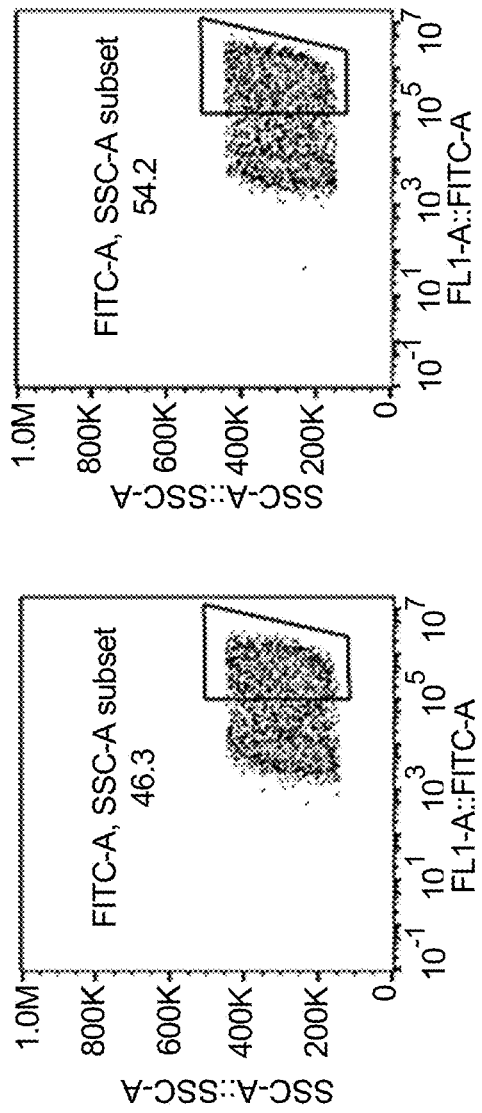
FIG. 25A shows a positive control experiment performed using 6808 cells, nCas9 a guide RNA targeting the 94_linker, and a single-stranded oligodeoxynucleotide donor.
FIG. 25B shows a positive control experiment performed using 6808 cells, nCas9 a guide RNA targeting the 94_linker, and another single-stranded oligodeoxynucleotide donor.

A range of control experiments were performed using untransformed HEK293T cells (FIG. 22A), and 6808 cells further exposed to: no plasmids, Cas9 alone, Cas9 and non-targeting guide RNAs, Cas9 with non-targeting guide RNAs and single-stranded oligodeoxynucleotide donors spanning the double stranded break (ssODN_3 or ssODN_4), or a Cas9 nickase (nCas9) with or without non targeting guide RNAs, and single-stranded oligodeoxynucleotide donors (ssODN_3 and ssODN_4) (FIGS. 22B-K). The treated cells were analyzed by Fluorescence-activated cell sorting with a GFP fluorescence cut off of $10^5$. As seen in FIGS. 22A-K the control experiments showed very low rates of fluorescent cells, well below 0.1% in all cases. FIG. 23 shows the results of an experiment using Cas9 and a guide RNA targeting the 94_linker (sgRNA6819, shown in FIG. 19), 17.2% of cells gained fluorescence as a result of this treatment. FIG. 24 shows the results of an experiment using a Cas9 nickase and a guide RNA targeting the 94_Linker (sgRNA6821, shown in FIG. 20), in this case 8.23% of the cells gained fluorescence. The number of fluorescent cells can be further increased by treating the 6806 cells with a Cas9 nickase, a guide RNA targeting the 94_Linker and ssODN_3 or ssODN_4 donors. These treatments resulted in 46.3% (FIG. 25A) and 54.2% (FIG. 25B) of cells becoming fluorescent respectively.

To analyze the forms of DNA repair occurring in the different treatment conditions DNA from GFP positive cells was collected and sequenced. Since multiple copies of the reporter fragments were integrated in the cells, the NHEJ and HDR percentages in the GFP positive cells were analyzed by MiSeq.

Transfected cells were collected after 72h transfection to analyze the GFP expression. GFP positive populations cells were bulk sorted by fluorescence activated cell sorting (FACS) using a BD FACS Aria2. 1 million GFP positive cells of each sample were collected to prepare the total DNA (DNeasy Blood & Tissue kit, QIAGEN). The amplicons were fixed at 300 bp and the sgRNA targeting site was in the region that sequencing can efficiently cover. PCR amplifications were performed with KAPA HiFi PCR Kit (KAPA-BIOSYSTEMS) following the manual. PCR conditions: 95° C. 5 min; 98° C., 20 s, 64° C., 20 s, 72° C. 20 s, 23 cycles, 72° C., 5 min. PCR products were checked by gel electrophoresis for the right amplicon. Then 10 PCRs for each sample were pooled and run on a 75 bp paired-end Miseq sequencing run.

Figure 27A:
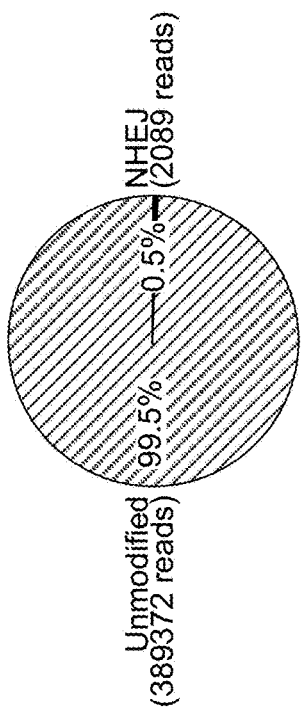
FIG. 27A shows the results of a sequencing reaction performed on untreated 6808 cells.
Figure 27B:
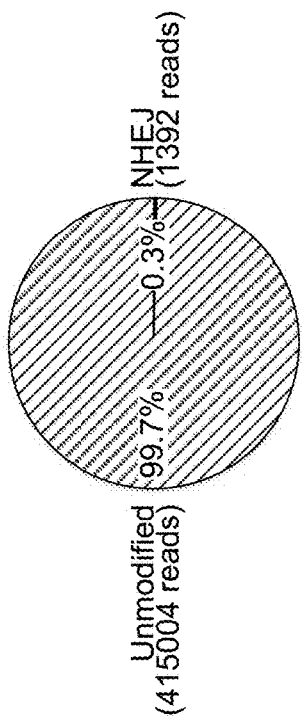
FIG. 27B shows the results of a sequencing reaction performed on 6808 cells treated with a Cas9n, a non-targeting guide RNA and ssODN_4 donor.
Figure 28:
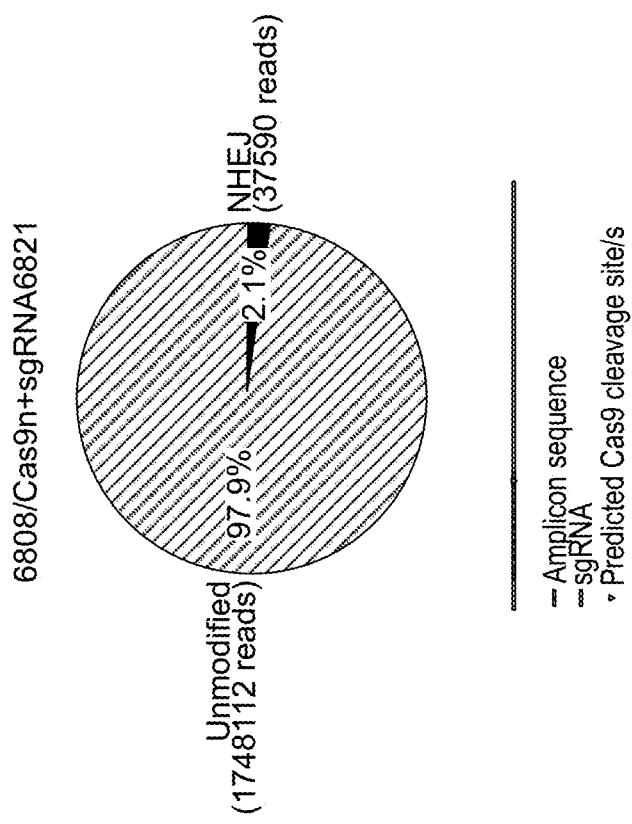
FIG. 28 shows the results of a sequencing reaction performed on 6808 cells treated with nCas9 and sgRNA6821.
Figure 29:
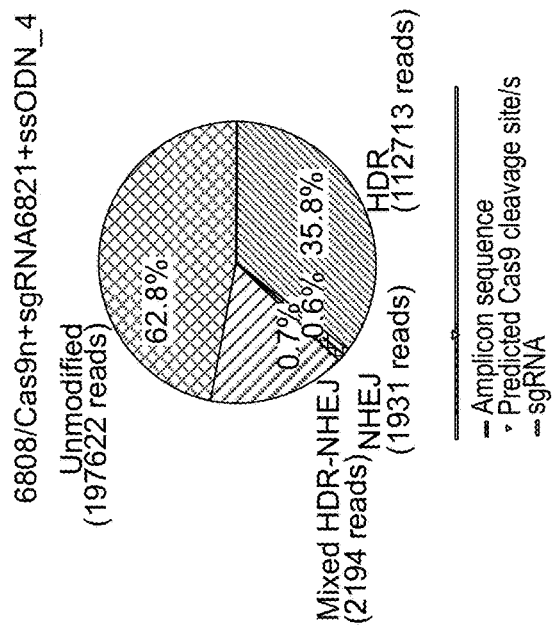
FIG. 29 shows the results of a sequencing reaction performed on 6808 cells treated with nCas9, sgRNA6821 and ssODN_4 donor.
Figure 30:
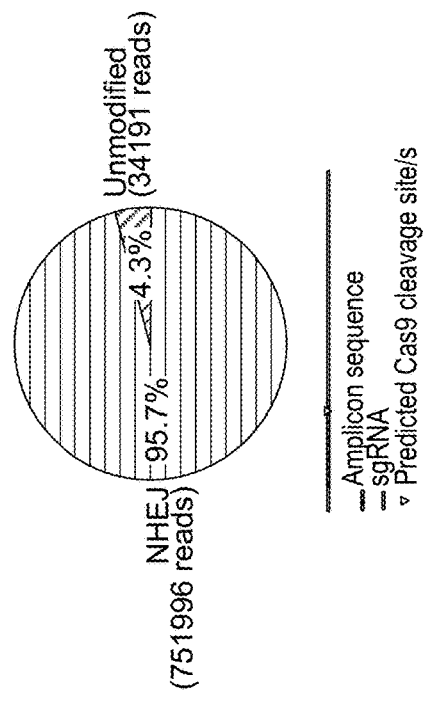
FIG. 30 shows the results of a sequencing reaction performed on 6808 cells treated with Cas9 and sgRNA6825.

FIG. 27A shows the results of a sequencing reaction performed on untreated 6808 cells, only 0.5% of the reads showed modifications consistent with non-homologous end joining repair, while 99.5% of the reads showed unmodified DNA. FIG. 27B shows results of sequencing reaction performed on 6808 cells treated with nCas9, a non-targeting guide RNA and ssODN_4, only 0.3% of the reads showed modifications consistent with non-homologous end joining repair, while 99.7% of the reads showed unmodified DNA. FIG. 28 shows results of sequencing reaction performed on 6808 cells treated with nCas9 and sgRNA6821. Interestingly 2.1% of the reads showed modifications consistent with non-homologous end joining repair, while 97.9% of the reads showed unmodified DNA. FIG. 29 shows results of sequencing reaction performed on 6808 cells treated with nCas9, sgRNA6821 and ssODN_4 donor, 35.8% of the reads showed modifications consistent with homology directed repair, 0.6% of the reads showed modifications consistent with non-homologous end joining repair, 0.7% of the reads showed modifications consistent with mixed homology directed repair and non-homologous end joining repair, and 62.8% of the reads showed unmodified DNA. FIG. 30 shows results of sequencing reaction performed on 6808 cells treated with Cas9 and sgRNA6825, 95.7% of the reads showed modifications consistent with non-homologous end joining repair, and 4.3% of the reads showed unmodified DNA. FIG. 31 shows results of sequencing reaction performed on 6808 cells treated with Cas9, sgRNA6825 and ssODN_4 donor; 10.9% of the reads showed modifications consistent with homology directed repair, 82% of the reads showed modifications consistent with non-homologous end joining repair, 0.9% of the reads showed modifications consistent with mixed homology directed repair and non-homologous end joining repair, and only 10.9% of the reads showed unmodified DNA.

The 6808 cell assay was used to assess DNA editing activity of different Agos as described herein. The reporter cell line 293T 6808 was seeded at 100K per well in a 12 well plate with 1 ml DMEM medium with 5% FBS. Cells were grown for 24 hours before the transfection using the recipe list in Table 27. 72 hours after transfection, cells were trypsinized from the plate, filtered through 70 uM cell strainers and analyzed by FACS as described above. FIGS. 32A and 32B show the results of the assay. As seen in FIG. 32A and FIG. 32B some of the Ago proteins resulted in significantly higher percentages of GFP positive cells than the negative controls.

TABLE 26

Sequences used in the 6808 cell assay.

| Description | Sequence (5' to 3') | SEQ ID NO: |
| --- | --- | --- |
| Non-target guide RNA (6823 and 6824) | GGCTGGCGCGGTATGGTCGGC | 377 |
| ssODN_03 | ACAAACAGTCCTGAGCAAAGATCCAA ATGAAAAAGACGTTGGTGGTGGCGGATCAGAAGGAGGCGGT AGCGGCCCTGGTTCGGGAGGGGAAGGTTCTGCTGGGGGAGG GAGCGCTGGCGG | 378 |
| ssODN_04 | CCGCCAGCGCTCCCTCCCCCAGCAGAA CCTTCCCCTCCCGAACCAGGGCCGCTACCGCCTCCTTCTGA TCCGCCACCACCAACGTCTTTTTCATTTGGATCTTTGCTCA GGACTGTTTGT | 379 |
| 94 linker | AGACCCCCCGCCAGCGCTCCCTCCCCCAGCAGAACCTTCCC CTCCCGAACCAGGGCCCGCTACCGCCTCCTTCTGATCCGCC ACCACCAACGTC | 415 |
| 92 linker | GACGTTGGTGGTGGCGGATCAGAAGGAGGCGGTAGCGGCCT GGTTCGGGAGGGGAAGGTTCTGCTGGGGGAGGGAGCGCTGG CGGGGGGTCT | 416 |
| ssODN_03 | ACAAACAGTCCTGAGCAAAGATCCAAATGAAAAAGACGTTG GTGGTGGCGGATCAGAAGGAGGCGGTAGCGGCCCTGGTTCG GGAGGGGAAGGTTCTGCTGGGGGAGGGAGCGCTGGCGG | 417 |
| ssODN_04 | CCGCCAGCGCTCCCTCCCCCAGCAGAACCTTCCCCTCCCGA ACCAGGGCCGCTACCGCCTCCTTCTGATCCGCCACCACCAA CGTCTTTTTCATTTGGATCTTTGCTCAGGACTGTTTGT | 418 |

TABLE 26-continued

Sequences used in the 6808 cell assay.

| Description | Sequence (5' to 3') | SEQ ID NO: |
|---|---|---|
| sgRNA6819_Targeting | GGTGGCGGATCAGAAGGAGG | 419 |
| sgRNA6821_Targeting | GATCAGAAGGAGGCGGTAGC | 420 |
| sgRNA6823_Targeting | GGCTGGCGCGGTATGGTCGGC | 421 |
| sgRNA6824_Targeting | GGCTGGCGCGGTATGGTCGGC | 422 |
| sgRNA6825_Targeting (FIG. 35) | GATCAGAAGGAGGCGGTAGC | 423 |

TABLE 27

Recipe for 6808 cell assay with Ago proteins

| | Optimized condition using 6808 cell line in 12 well plate | |
|---|---|---|
| Positive control | Plasmid 6821 | 1.5 ug |
| | ssODN | 0.8 ug |
| | Transit | 6 ul |
| | Opt medium | 200 ul |
| complete assay | Ago plasmid | 1 ug |
| | gDNA | 0.25 ug |
| | ssODN | 0.8 ug |
| | pSLQ1339 | 1 ug |
| | sgRNA1 for dCas9 | 0.75 ug |
| | Transit | 6 ul |
| | Opt medium | 200 ul |

TABLE 28

Expression Vector utilized in ssDNA cleavage assay

| SEQ ID NO: | Sequence |
|---|---|
| 384 | TACTGGAACGTTGTGAGGGTAAACAACTGGCGGTATGGATGCGGCGGGACCAGAGAAAAATCACTCAGGGTCAATGCCA GCGCTTCGTTAATACAGATGTAGGTGTTCCACAGGGTAGCCAGCAGCATCCTGCGATGCAGATCCGGAACATAATGGTGC AGGGCGCTGACTTCCGCGTTTCCAGACTTTACGAAACACGGAAACCGAAGACCATTCATGTTGTTGCTCAGGTCGCAGAC GTTTTGCAGCAGCAGTCGCTTCACGTTCGCTCGCGTATCGGTGATTCATTCTGCTAACCAGTAAGGCAACCCCGCCAGCCT AGCCGGGTCCTCAACGACAGGAGCACGATCATGCGCACCCGTGGGGCCGCCATGCCGGCGATAATGGCCTGCTTCTCGC CGAAACGTTTGGTGGCGGGACCAGTGACGAAGGCTTGAGCGAGGGCGTGCAAGATTCCGAATACCGCAAGCGACAGGC CGATCATCGTCGCGCTCCAGCGAAAGCGGTCCTCGCCGAAAATGACCCAGAGCGCTGCCGGCACCTGTCCTACGAGTTGC ATGATAAAGAAGACAGTCATAAGTGCGGCGACGATAGTCATGCCCCGCGCCCACCGGAAGGAGCTGACTGGGTTGAAG GCTCTCAAGGGCATCGGTCGAGATCCCGGTGCCTAATGAGTGAGCTAACTTACATTAATTGCGTTGCGCTCACTGCCCGCT TTCCAGTCGGGAAACCTGTCGTGCCAGCTGCATTAATGAATCGGCCAACGCGCGGGGAGAGGCGGTTTGCGTATTGGGC GCCAGGGTGGTTTTTCTTTTCACCAGTGAGACGGGCAACAGCTGATTGCCCTTCACCGCCTGGCCCTGAGAGAGTTGCAG CAAGCGGTCCACGCTGGTTTGCCCCAGCAGGCGAAAATCCTGTTTGATGGTGGTTAACGGCGGGATATAACATGAGCTGT CTTCGGTATCGTCGTATCCCACTACCGAGATATCCGCACCAACGCGCAGCCCGGACTCGGTAATGGCGCGCATTGCGCCC AGCGCCATCTGATCGTTGGCAACCAGCATCGCAGTGGGAACGATGCCCTCATTCAGCATTTGCATGGTTTGTTGAAAACC GGACATGGCACTCCAGTCGCCTTCCCGTTCCGCTATCGGCTGAATTTGATTGCGAGTGAGATATTTATGCCAGCCAGCCAG ACGCAGACGCGCCGAGACAGAACTTAATGGGCCCGCTAACAGCGCGATTTGCTGGTGACCCAATGCGACCAGATGCTCC ACGCCCAGTCGCGTACCGTCTTCATGGGAGAAAATAATACTGTTGATGGGTGTCTGGTCAGAGACATCAAGAAATAACGC CGGAACATTAGTGCAGGCAGCTTCCACAGCAATGGCATCCTGGTCATCCAGCGGATAGTTAATGATCAGCCCACTGACGC GTTGCGCGAGAAGATTGTGCACCGCCGCTTTACAGGCTTCGACGCGCTTCGTTCTACCATCGACACCACCACGCTGGCAC CCAGTTGATCGGCGCGAGATTTAATCGCCGCGACAATTTGCGACGGCGCGTGCAGGGCCAGACTGGAGGTGGCAACGCC AATCAGCAACGACTGTTTGCCCGCCAGTTGTTGTGCCACGCGGTTGGGAATGTAATTCAGCTCCGCCATCGCCGCTTCCAC TTTTTCCCGCGTTTTCGCAGAAACGTGGCTGGCCTGGTTCACCACGCGGGAAACGGTCTGATAAGAGACACCGGCATACT CTGCGACATCGTATAACGTTACTGGTTTCACATTCACCACCCTGAATTGACTCTCTTCCGGGCGCTATCATGCCATACCGCG AAAGGTTTTGCGCCATTCGATGGTGTCCGGGATCTCGACGCTCTCCCTTATGCGACTCCTGCATTAGGAAGCAGCCCAGTA GTAGGTTGAGGCCGTTGAGCACCGCCGCCGCAAGGAATGGTGCATGCAAGGAGATGGCGCCCAACAGTCCCCCGGCCAC GGGGCCTGCCACCATACCCACGCCGAAACAAGCGCTCATGAGCCCGAAGTGGCGAGCCCGATCTTCCCCATCGGTGATGT CGGCGATATAGGCGCCAGCAACCGCACCTGTGGCGCCGGTGATGCCGGCCACGATGCGTCCGGCGTAGAGGATCGAGA TCTCGATCCCGCGAAATTAATACGACTCACTATAGGGGAATTGTGAGCGGATAACAATTCCCCTCTAGAAATAATTTTGTT TAACTTTAAGAAGGAGATATACCATGAAACATCACCATCACCATCACAACACTAGTAGCAATTCCATGTCCCCTATACTAG GTTATTGGAAATTAAGGGCCTTGTGCAACCCACTCGACTTCTTTTGGAATATCTTGAAGAAAATATGAAGAGCATTTGT ATGAGCGCGATGAAGGTGATAAATGGCGAAACAAAAAGTTTGAATTGGGTTTGGAGTTTCCCAATCTTCCTTATTATATTG ATGGTGATGTTAAATTAACACAGTCTATGGCCATCATACGTTATATAGCTGACAAGCACAACATGTTGGGTGGTTGTCCAA AAGAGCGTGCAGAGATTTCAATGCTTGAAGGAGCGGTTTTGGATATTAGATACGGTGTTTCGAGAATTGCATATAGTAAA |

TABLE 28-continued

Expression Vector utilized in ssDNA cleavage assay

| SEQ ID NO: | Sequence |
|---|---|
| | GACTTTGAAACTCTCAAAGTTGATTTTCTTAGCAAGCTACCTGAAATGCTGAAAATGTTCGAAGATCGTTTATGTCATAAAA<br>CATATTTAAATGGTGATCATGTAACCCATCCTGACTTCATGTTGTATGACGCTCTTGATGTTGTTTTATACATGGACCCAAT<br>GTGCCTGGATGCGTTCCCAAAATTAGTTTGTTTTAAAAAACGTATTGAAGCTATCCCACAAATTGATAAGTACTTGAAATCC<br>AGCAAGTATATAGCATGGCCTTTGCAGGGCTGGCAAGCCACGTTTGGTGGTGGCGACCATCCTCCAACTAGTGGATCTGG<br>TGGTGGTGGCGGATGGATGAGCGAGAATCTTTATTTTCAGGGCGCCATGGCTGGCAAGGCACACAGGCTGAGTGCTGAG<br>GAACGGGACCAGCTGCTGCCAAACCTGCGGGCCGTGGGGTGGAATGAACTGGAAGGCCGAGATGCCATCTTCAAACAGT<br>TCCATTTTAAAGACTTCAACAGGGCTTTTGGCTTCATGACAAGAGTCGCCCTGCAGGCTGAAAAGCTGGACCACCATCCCG<br>AGTGGTTTAACGTGTACAACAAGGTCCATATCACCTTGAGCACCCACGAATGTGCCGGTCTTTCTGAACGGGATATAAACC<br>TGGCCAGCTTCATCGAACAAGTTGCCGTGTCTATGACATAGGTACCGGATCCGAATTCGAGCTCCGTCGACAAGCTTGCG<br>GCCGCACTCGAGCACCACCACCACCACCACTGAGATCCGGCTGCTAACAAAGCCCGAAAGGAAGCTGAGTTGGCTGCTGC<br>CACCGCTGAGCAATAACTAGCATAACCCCTTGGGGCCTCTAAACGGGTCTTGAGGGGTTTTTTGCTGAAAGGAGGAACTA<br>TATCCGGATTGGCGAATGGGACGCGCCTGTAGCGGCGCATTAAGCGCGGCGGGTGTGGTGGTTACGCGCAGCGTGACC<br>GCTACACTTGCCAGCGCCCTAGCGCCCGCTCCTTTCGCTTTCTTCCCTTCCTTTCTCGCCACGTTCGCCGGCTTTCCCCGTC<br>A<br>AGCTCTAAATCGGGGGCTCCCTTTAGGGTTCCGATTTAGTGCTTTACGGCACCTCGACCCCAAAAAACTTGATTAGGGTGA<br>TGGTTCACGTAGTGGGCCATCGCCCTGATAGACGGTTTTTCGCCCTTTGACGTTGGAGTCCACGTTCTTTAATAGTGGACT<br>CTTGTTCCAAACTGGAACAACACTCAACCCTATCTCGGTCTATTCTTTTGATTTATAAGGGATTTTGCCGATTTCGGCCTAT<br>T<br>GGTTAAAAAATGAGCTGATTTAACAAAAATTTAACGCGAATTTTAACAAAATATTAACGTTTACAATTTCAGGTGGCACTT<br>TTCGGGGAAATGTGCGCGGAACCCCTATTTGTTTATTTTTCTAAATACATTCAAATATGTATCCGCTCATGAATTAATTCTT<br>A<br>GAAAAACTCATCGAGCATCAAATGAAACTGCAATTTATTCATATCAGGATTATCAATACCATATTTTTGAAAAAGCCGTTTC<br>TGTAATGAAGGAGAAAACTCACCGAGGCAGTTCCATAGGATGGCAAGATCCTGGTATCGGTCTGCGATTCCGACTCGTCC<br>AACATCAATACAACCTATTAATTTCCCCTCGTCAAAAATAAGGTTATCAAGTGAGAAATCACCATGAGTGACGACTGAATC<br>CGGTGAGAATGGCAAAAGTTTATGCATTTCTTTCCAGACTTGTTCAACAGGCCAGCCATTACGCTCGTCATCAAAATCACT<br>CGCATCAACCAAACCGTTATTCATTCGTGATTGCGCCTGAGCGAGACGAAATACGCGATCGCTGTTAAAAGGACAATTAC<br>AAACAGGAATCGAATGCAACCGGCGCAGGAACACTGCCAGCGCATCAACAATATTTTCACCTGAATCAGGATATTCTTCT<br>AATACCTGGAATGCTGTTTTCCCGGGGATCGCAGTGGTGAGTAACCATGCATCATCAGGAGTACGGATAAAATGCTTGAT<br>GGTCGGAAGAGGCATAAATTCCGTCAGCCAGTTTAGTCTGACCATCTCATCTGTAACATCATTGGCAACGCTACCTTTGCC<br>ATGTTTCAGAAACAACTCTGGCGCATCGGGCTTCCCATACAATCGATAGATTGTCGCACCTGATTGCCCGACATTATCGCG<br>AGCCCATTTATACCCATATAAATCAGCATCCATGTTGGAATTTAATCGCGGCCTAGAGCAAGACGTTTCCCGTTGAATATG<br>GCTCATAACACCCCTTGTATTACTGTTTATGTAAGCAGACAGTTTTATTGTTCATGACCAAAATCCCTTAACGTGAGTTTTC<br>GTTCCACTGAGCGTCAGACCCCGTAGAAAAGATCAAAGGATCTTCTTGAGATCCTTTTTTTCTGCGCGTAATCTGCTGCTTG<br>CAAACAAAAAAACCACCGCTACCAGCGGTGGTTTGTTTGCCGGATCAAGAGCTACCAACTCTTTTTCCGAAGGTAACTGGC<br>TTCAGCAGAGCGCAGATACCAAATACTGTCCTTCTAGTGTAGCCGTAGTTAGGCCACCACTTCAAGAACTCTGTAGCACCG<br>CCTACATACCTCGCTCTGCTAATCCTGTTACCAGTGGCTGCTGCCAGTGGCGATAAGTCGTGTCTTACCGGGTTGGACTCA<br>AGACGATAGTTACCGGATAAGGCGCAGCGGTCGGGCTGAACGGGGGGTTCGTGCACACAGCCCAGCTTGGAGCGAACG<br>ACCTACACCGAACTGAGATACCTACAGCGTGAGCTATGAGAAAGCGCCACGCTTCCCGAAGGGAGAAAGGCGGACAGGT<br>ATCCGGTAAGCGGCAGGGTCGGAACAGGAGAGCGCACGAGGGAGCTTCCAGGGGGAAACGCCTGGTATCTTTATAGTC<br>CTGTCGGGTTTCGCCACCTCTGACTTGAGCGTCGATTTTTGTGATGCTCGTCAGGGGGGCGGAGCCTATGGAAAAACGCC<br>AGCAACGCGGCCTTTTTACGGTTCCTGGCCTTTTGCTGGCCTTTTGCTCACATGTTCTTTCCTGCGTTATCCCCTGATTCTG<br>TGGATAACCGTATTACCGCCTTTGAGTGAGCTGATACCGCTCGCCGCAGCCGAACGACCGAGCGCAGCGAGTCAGTGAGC<br>GAGGAAGCGGAAGAGCGCCTGATGCGGTATTTTCTCCTTACGCATCTGTGCGGTATTTCACACCGCATATATGGTGCACTC<br>TCAGTACAATCTGCTCTGATGCCGCATAGTTAAGCCAGTATACACTCCGCTATCGCTACGTGACTGGGTCATGGCTGCGCC<br>CCGACACCCGCCAACACCCGCTGACGCGCCCTGACGGGCTTGTCTGCTCCCGGCATCCGCTTACAGACAAGCTGTGACCG<br>TCTCCGGGAGCTGCATGTGTCAGAGGTTTTCACCGTCATCACCGAAACGCGCGAGGCAGCTGCGGTAAAGCTCATCAGCG<br>TGGTCGTGAAGCGATTCACAGATGTCTGCCTGTTCATCCGCGTCCAGCTCGTTGAGTTTCTCCAGAAGCGTTAATGTCTGG<br>CTTCTGATAAAGCGGGCCATGTTAAGGGCGGTTTTTTCCTGTTTGGTCACTGATGCCTCCGTGTAAGGGGATTTCTGTTC<br>ATGGGGGTAATGATACCGATGAAACGAGAGAGGATGCTCACGATACGGGTTACTGATGATGAACATGCCCGGT |

SEQUENCE LISTING (414 sequences)

SEQ ID NO: 1 - DNA, 843 bp, Rhizobium etli CIAT 652
gatcacgtcgcccaccgcgtcggcgaaacgtatcgtcaccggcaatcgatcgttatgcaggcaagaattgaaattgatcttggtcaggcccatcacgtccccgagaaccgtttcaagttcgcaatctccgcggtgaatgcggacttctatcggattcggcgtctctggcccttgggaggtatcaaggcgcggggcgaatcccgacgtccagaggaacgcgcggcgttcgtgcaatatcaaggccgttccgcggatgaccggatatcgaccgggccggtatagcttcatgcggtctttcgcatcggaaatctgcactcctacgacattggtccccggagcagcggccttgaagcctttccattccgggtccgcgaacgaggacttggcatgaatgaacagctcagcgggcggctgtccatcatgcatttgttgatattcgccgataaccatctcaactaaactgcttgccgcgtcctcgctcagatgaaattgcttggattcggaatgaaaccatgggccgagcgcaccgcgaaatacgacgccttcaccgctcgaaagaaacatctgggcggcgcaacaggcgaagcgatcatcggaactattgtcctgtcgcttataggcgaggccgacatagcaaacgccgggtctgacgtcggccaactgccatggtcgtccaccatccttgtaataggcgccggtcaatattttccaggcgatcgttgcagggtcctccaatcgtcgcagtggcttgccgattttgttcaggaaatcgttaggcgccaatgtggtttccctaacgatctgagtgacgatacggtctctgagcagacgtgccttcaactg

SEQ ID NO: 2 - DNA, 858 bp, Novosphingobium resinovorum
gatctgcatcaccagctcaaagccttcaccgccgcgcggcagctgcccattcagattgtgcgcgaagacagcgcactatcctatcgatgccgggccagcgtcatgtggcggatcggcctggcgctctacgccaaggctggcggcgttccttggaaactggccgatgtggagccggacactgcctatattggtatctcctatgcgctccggcccgcagaatcggagcttgcccgcttcgtaacctgttgcagccaggtcttcgacgccgacggtgctggactggaattcatcgcctatgacaccggcgatgtgaacgtacagcgggagaacccgtttctctcgcataccgagatgtttcgggtcatcacccgttcgctggacctttatcgccggcgccatggcggcagactgccgacacgtgtgatgatccacaaatcgaccgagttcaaggaagccgaaatagaaggctgcttcgaagcgctgaaacatatcgagtcggtcgatctcatccagatcgtcgaggacaatggctggcagggcgtgcgatgggaacaggaccgtaacgatccggagatatcacaagcggatgggtatccggtgaaacgcggaaccttgctcgggctcagcggcaaagacgctttgctctggatgcacggggcagtcgatggtttcgggcgccgcccctattttcaaggtggcaaaggtacaccgcgaccgttgcgactggtccgacatgccgggcatggaacatgggacgataccgcgaaggcggccctggcgctgtcgaaaatgaactggaacaatgacgggctctatgatccacttccggtgacgatgagctacgcaaagaccttagca

SEQ ID NO: 3 - DNA, 843 bp, Rhizobium sp. N113
gatcacgtcgcccaccgcgtcggcgaaacgtatcgtcaccggcaatcgatcgttatgcaggcaagaattgaaattgatcttggtcaggcccatcacgtccccgagaaccgtttcaagttcgcaatctccgcggtgaatgcggacttctatcggattcggcgtctctggcccttggtaggtatcaaggcgcggggcgaatcccgacgtccagaggaacgcgcggcgttcgtgcaatatcaaggccgttccgcggatgaccggatatcgaccgggccggtatagcttcatgcggtctttcgcatcggaaatctgcactcctacgacattggtccccggagcagcggccttgaagcctttccattccgggtccgcgaacgaggacttggcatgaatgaacagctcagcgggcggctgtccatcatgcatttgttgatattcgccgataaccatctcaactaaactgcttgccgcgtcctcgctcagatgaaattgcttggattcggaatgaaaccatgggccgagcgcaccgcgaaatacgacgccttcaccgctcgaaagaaacatctgggcggcgcaacaggcgaagcgatcatcggaactattgtcctgtcgcttataggcgaggccgacatagcaaacgccgggtctgacgtcggccaactgccatggtcgtccaccatccttgtaataggcgccggtcaatattttccaggcgatcgttgcagggtcctccaatcgtcgcagtggcttgccgattttgttcaggaaatcgttaggcgccaatgtggtttccctaacgatctgagtgacgatacggtctctgagcagacgtgccttcaactg

SEQ ID NO: 4 - DNA, 825 bp, Tessaracoccus sp. NSG39
gacctgcacgaccggttgaaggcgacggccgcgctgctgggctgtcctatccagatgatccgcgagacctccgcgctgcagttcaggtacaagtgctccatgtactggcggctgtcgattgcgctgctgacgaaggctggcggcgtgccgttccggatgatgcgtcccactgagtccgacactgcctacctcgggctggcctacgcgattcgcggcgggaccgccaacgagttcgtcacctgctgctcgcaggtcttcgacgccgaaggcggcggcttcgaatttatcgcctacaacgtcggcgccgaccgtgacctggagaacccgcatctgacccgcgacgagatgcgcaccgtcatggcgcgcagcgctcgcctctaccagcggcgcagggccgggtctctgccccagcggcttgtgatccacaagacgacaacctggcgtgaggaagaagtcgcaggggtcttcgacgcgtggagcccggccgttcctgacatcgagtgcctccaggtacgtctagacacaccctggaccggggttgccctccgcggcggcaagggcaactcggcggtcgccaacgaatggcctgtgggccgcgggtctcttcagtatctctctgggcgggaggcactcctgtggatcgccggtacggcgaagggtgtcgcgctgacgggtgagaactataatcaggcagccaaggctctaccgaccccgattgcgttcaagcgtgacgcgggtgctggccccctggagattcctgccagcgaaatccttgccctgtcgaagctcgactggaacaacgacgccctttacggtgtgaccccg

SEQ ID NO: 5 - DNA, 153 bp, Bradyrhizobium japonicum
catttccacaaccagctcagggccaggctacttggctgcgaggcgatcacccagctcgtgcgcagaccgccattgccccgcgcgaatacctcaacagcaagggcgagctttcccgcaagatgcaggatgacgcaccgtcgcgtggaatctcac

SEQ ID NO: 6 - DNA, 216 bp, Bradyrhizobium japonicum
caagatgcaggatgacgcaccgtcgcgtggaatctcacgactggtgtctattacaaagcgggcgagaagccgtggtctcttgccgacatccgggatggcgtctgctacacaggcctcgtcttcaagcgtacaaacaacccggtcgaagcgaaggaggcgtgctgtggcgcgcagatgttccctcataccggcgaaggcatcgaacgccgcggctgc

SEQ ID NO: 7 - DNA, 723 bp, Pelagibacterium halotolerans B2
gaggacatctccgaccgcgttggcgaaacggatcgtcaccggtaaccggtcattgtgaaggcacgaattgaagttgatcttcgtgagcccgagcacgtcggcgaggaccgtcgtcagtgggcactcgccgcgaagaacgcgaaccgaaatcgggttcggggtctcaggccccatataggtgtccagccgtggcacatagcccgaggtccacagaagtgcgtgacgttcaccgatctgcagcgccgtgccgcgaatgacgggatactctccaggacgatagagcttcaggtcatcacgagcctcggcaatctgcacaccgacgaggttggtctcatccccgcaggcggacgaaaaaccgcgccattcgttgtcggtaaaggcggacttcgcgtggatgaagagttcggttggtgggccatcgtgcaggcgggtgtattcgcccaccaccatcttgataaggttcctggcggcatccttatcaaggtggaactgcttcgtatcggtttggaaccaagggccgagcgcgccgcggaagaccacgccttccccgtcagcgagaaacatttgggctgcgcagcaggcatgacgcttgtcgcttgttagttcgctgcgtttgtagaccagtccgacataacagacgcccggtcgaacatcggccaactgccaaggcttcccgccagccttgtagtaggcgcccgttcccattttccaggcgatagtcgc

SEQ ID NO: 8 - DNA, 885 bp, Agrobacterium tumefaciens
gatgctcacgacacactcaaggcattgggcgcgaaatataatataccaacgcaggtgctcaatgaccgtgtctttgcgttttcacaccctgcgtcgcgatcctggcggctggcgatagcgctttatgttaaggcagcgggcacaccttggaagcttgcgcccctgaaaggtgtacctgaggacacggcttacatcggcctcgcctacgccttacggggcgaccagcgggatgcgcactatgtgacgtgctgttcccaggtgtttgatatggatggcggaggaatgcagttcgttgccttcgaggccaaggatcctatcgccgatgtcgcagaagcgcgtcgaaatccatttctcagtcgagatgatatgcgcgcggttcttgctcgcagcctcgagctctatcaaggaagaaatggaggaacactgccgaagcggcttgtcattcataagaccacagcattcaaaccggatgagatcgagggtgcgtttgatgcacttgccggggtgcaagaaatcgagtgcattgaagttagcccagcttccggttggcgtggggtatggctggtaccgagcggacagccgaagccgccgaccaagcctgcgggctaccctgttccgagaggcaccgttgtcgtccggtccgggacctcggcgcttgtttgggtcgcgggcaatgctcccgaagtgtctaataagggcgactattatcagggaaagaagagcattccaaagccgttgcagctgatcaggcacgcaggcagtggaccgttggagctatcggctcacgaggccttggctctcaccaagatggattggaacaatgatgctctctacgatcctgtgcctgttagcatccgatactcgcaacgcttagccaagacgatc

SEQ ID NO: 9 - DNA, 864 bp, Burkholderia xenovorans LB400
gatctacacgatttcgtcaaggcggcggcgattccgaaaggttgcgccacacagtttgtcgaagaggacaccctccgtaacacgcagcagcaatgccgcgtgcgctggtggctctcgcttgccctgtacgtgaaaagcatgcgcacgccgtggactttggaaggcctcagcgagaaatccgcctacgtgggtctcggcttcagcgtcaaacgcaagacgacacagaatgcgggcgcacacgtcgtgctgggctgtagccacctctatagcccgaacggcatcggtctgcagttccgcctgagcaagatcgaagatccaattatgcgcaacaagaatcccttcatgagcttcgacgatgcaagacggctcggtgagggcatccgtgaactgtttttcgccgcccaacttcgacttcctgagcgagtggtgatccacaagcagaccccattccttcgcgaagaacgcagtgggctccaggctggactcgagggagttgcgtgcgtagagctattgcagatcttcgttgacgacacgctacggtatgtggcgtcccatccgacctccgacggaaagttcgagaccgacaactatcccatccggcggggaacgacagtggtcatcgacgatcacacggctcttctgtgggtccacggcgcatctactgcactaaatcccagaaggcactatttccagggcaagcgtcgaattccagcccccttggtaattcggcgtcatgcgggcacgaccgatttgatgacgatcgccgacgaagttctcggcttgtcgaagatgaatttcaacagcttcgacctttacgggcaacttccagcgacgatcgagacgtcacgccgcgttgcgaagatc

SEQ ID NO: 10 - DNA, 852 bp, Variovorax paradoxus B4
accgatgcgcgcgacccgttgagaggtttcgatggttgcgggcaactgcccatagagatcaaagctgttgaagttcatcttggacaggccaaggatttcatcggccagcatcatgagatcgctagtgccggcgtggcggcgcatcacgagcggggccggaattcggcgcttcccctgaaagtaggattgcctagggttgagagcggtagaggttccgtgcacccacagcaatgctgtctgatcgtccactacaaccgttgtgccgcgtcgaatcggatagccgtgaatctcgaagtcgccattgggcatcgggcgcgatgccacgtaccgcaaggtgtcatcgacgaagatctgcaacaactcgacgcaggccacgccctccaggccagcttgcagcccctcgcgctcctccttcaggaaaggcgtttgcttgtgcaccacgacgcgattgggaaggcgtaggtgggcgtcgaagaacagctctcggatgccttccccaagctttcgcgcgtcgtcgaagctcatgaaggggttcttgcgcagcatgatcgggttgtcgatcttgctcaggcggaattgaaggccgtgaccattggggctgtagaggtggctgcagcccagcgcgacatggccttcgccgtcgatctttcggcggacgctgaagccgaggcccacgaaggcggaatccctatcaaggccggtgagggcccagggggtgcgcatggctttcacgtacacagccagagacaaccaccatcgaacgcggcattgctgaccgttggcgagagtgctttcttcgagaaactgagtggagcaaccagccgggatggccgcggccttcacaaaatcgtg

SEQ ID NO: 11 - DNA, 843 bp, Rhizobium sp. N871; identical to SEQ ID NO: 3

SEQ ID NO: 12 - DNA, 888 bp, Cupriavidus sp. USMAA1020
gacgcccacgacgcgttgaaggcccttggagcccggtacgccatcccaacgcaggtcatcaacgatcgcgttttcacattccggctcaaggcgtcgttggcctggcgcctggccatcgcgctcttcaccaaggcgggcggcattccctggaaactcgcgccgatggtcggtgtaccagaagacacggcctatatcggtctcgcctacgcgttgcgcggggaccccaagtccgcgcagttcgtcacgtgctgctcgcaggtgttcgacgcggacggcggtggcatgcagttcgtcgctttcgaggccaaggagcaggtggcggatccgcgcgaagccagacggaacccgtttctcagtcggagcgacatgcgggcggtaatggcacgtagcctgagcctctaccttgggcgtaatggtggacggctgccgcgacgtctcgtcgtccacaaaacgacgtcgttcaaggacgaagaactccaaggcgttttcgacggcctgtcgacggttccagaggtggagtgcatcgagatcggcagcagcgccacatggcgtggcgtgtggctgaagcagggaaagaagggcggacccaaaagtgtgcctgatcgagcgccggtgccgcggggaactgtcctcacgcgaacggaccggtcggcgctgttgtgggcatcgggcaatgccccgtcggcagcgctcagcggtgccttgtttttccagggaagcaagagcattccgcgcccgctcaacatcatccgtcacgcgggcagcggtccgctggaagttgctgcgttggaaaccctcgcgctgaccaaaatggactggaacaacgacgcgttgtacgacccggttccggtgaccattcgctattcgcaacggctcgcacgtaccatc

SEQ ID NO: 13 - DNA, 819 bp, Roseomonas gilardii
agcccttactggtgggcgaaggctgcgttcctgcggcgcgacgtgccagtgcaggcactctccgccgagatgatggccatgggcgacttcgagtacgcctgcgctttggcaaacgtcagcttggccacttacgccaagctcggcggtaccccttggctgctgaaggcccggccctcgacagatcacgagcttgtctttggcctcggatctcatacccacaaggagcgacgtcgaggtgcaggggaacgggtcgtcgggatcacgaccgtgttctctagccagggtaactatctactagatgcccgaacggctgcagtaccgttcgaccgctacccggaggcactgcgcgccacgctcatcgaggcggtcaagcgcatacggcaagaggaggcctggcgcgcgggcgacacggtgcgcttggtcttccatgccttcacccagatgcgacaagagactgcggatgccgtggttgccgctgtggaaagcatgggcctgagtggggtgaagttcgccttcctccatgtggccgaggaccacccattcacgctgttcgaccacgcctcagcgactggcaagggtgcctatgcgcccgagcgtgggcaggccgtagaactcagcgaccacgagtggctcctttccctcaccggacgggatcagatcagagccgcgtcgcagggcatccctgatccggtgctactccgcctgcacgagaaatcgacctttcgcgacatgcgaacgctgacgcgtcaggtatcggatttcgcctgccactcctggcgtacttacgaacgagctaggctcccgatcacactcctctac

SEQ ID NO: 14 - DNA, 843 bp, Rhizobium sp. N1341; identical to SEQ ID NO: 3

SEQ ID NO: 15 - DNA, 843 bp, Rhizobium sp. N6212; identical to SEQ ID NO: 3

SEQ ID NO: 16 - DNA, 858 bp, Acidobacterium capsulatum ATCC 51196
aacccgtactacaccactaaagcgcgattgatggcgcaaggtgttccagtacaactattgaatatcgaaaccatccgtcgaaaaagccttgactacattctcaataatatcgggcttgctatgtacgcgaagcttggcggaatcccttggacgctgacccagaacagcgatatggcgcacgagattatcgttggtataggaagcgccagattgaacgaaagccgtcgtggtgcaggcgagcgggtgatcggaattacgaccgttttcagcggcgatggccagtacctgttggcaaacaatactcaagaggtgccttcagaagagtacgttgatgctctgactcagtctctctcggagactgtgagtgaactcaggagccgattcggttggagaccaaaagacagggtccgattcatcttccatcaaaagttcaagaagtacaaagatgctgaagctgaggcagttgatcgcttcgcacgatcactcaaagatttcgacgtgcaatatgccttcgttcatgtcagtgactcgcacaactggatgttgctagatcccgcatcgaggggagtgaagttcggcgacacaatgaagggagtggcggtcccgcagaggggacaatgtgtgcctctagggccaaacgctgctcttttgactttgtccgggccatttcaggtcaagacgccactgcaaggttgccctcatccagtactggtgagcattcacgagaagtccacgttcaagagcgtggattatatcgctcgccaaattttcaatctcagcttcatctcatggaggggtttcaacccgtcaacgcttccagtttcgatttcttactcagacatgatcgtagatctgttg

SEQ ID NO: 17 - DNA, 825 bp, Bacteroidales bacterium CF
aattttagaagagcattaaaagcccgtgcaatgaaatacaacacacctattcagttgttgagagaatatgtaatgcacgacagtaacaaatcacaagataatgcaactaaggcatggaatttttgcactgctctttattataagggacttcaaaccattccttggaagttggaagtagacgagaacaaaccaaaagtatgttttgtaggtattggattctacaaaagcagggacaagaaaacgattcaaaccagtttagcacaaattttcaatgaaaatggaaaaggtgtgatacttcgcggaactcctgtaactgaagataaagacgataaaaaacctcacttaacttatgagcaatctttaagccttctgaaagatgccttgaccaaatacaagtttgcgacaggttcaatgccaggtagagtagttttacacaagacttcaaaatactatgaggatgaacttgacggctttattcaagcaatgcaggatttgggtataactgaatacgatattgtaactatcatggaaaccgatttgcgtttctttagaaataatctttatccaccagtgagaggggcagttttttcattgactgaacaaagacacatactttacactaggggttcagttcatcaatatcagacatatccaggaatgtatattcctgctccattagaagtaagaatagtaagttccgtttcatctataaggacagtttgtaaagaaattcttggcttgacaaaaatgaattggaacaacacccaattcgacaacaaataccccattacaattggctgtgcaagacgggtaggagaaataatg

SEQ ID NO: 18 - DNA, 452 bp, Rhizobium leguminosarum
aagaacctcaccaacctttcgtgcggcccggatgggaatgggcagcttctggttcatctgggtcgaattccagttgatcttcgtcatcgacagcacgtctttggcgatctgcgcgacggtgctgtcgctgcttttgtgcggacatagcagaaatggcctgggatcatactggcctggataggttccgtagtacgggatgctgccgttcgtatagagaagccctttcccgtcgagttcgacaaaggtgccgcgcatcacgggatagttcccgtcgcggaggactttcaccgacgaggattcctggacccatacaaggtccttcatctccgtgcccgcagcgtcgagcgcctccacgttccgtccgcttcctcgtcacggaaacgcgaggttttcaggacggcgacacggaccgggtagtgccgatgatggttcttgtaggcggtcagcaccgc

SEQ ID NO: 19 - DNA, 861 bp, Acidobacterium capsulatum ATCC 51196
gattttcaccgccaggtgaaagcgcgtctgctcaagctaggtcgcacttcgcaactcatccgcgaaacgacgttggcacccgacaaattcctaaataacgcgggctatccaaagcgtgggttgcaggatccggcgacagtggcgtggaatctggcaactggactttactacaaaacccaacccttgccgccgtggaaactcgcgcatgtcaggccgggcgtttgttacatcggacttgttttcaagatgattccgaatgatccaaaggaacatgcctgctgtgcggcgcagatgtttcttaatgagagcgacgccgttgttttcaggggcgcaaatggcccgtggaaaaccgacgactttgaattccaccttcaacccaaagaggcgcaaagcctgattgccaaagtgctcaaaaccttcgaggagaagcacggtgtgccaccaaaggaatttttcatccacgggtgcacaaccttcaacgaggatgaatggaaagccttcaaaaaggccacgccgaagggcaccaatcttgtcggcgtccgcatcaaggaaaccaaaggggaatccaagctgttccgtgatggtgattatccggtaatgaggggaacggccatcattcttgatcaccgaaacgccttgctgtggacgaatggatttgtgccacggctggacacctatattgggcctgagacgccaaacccgcttttgataaccgttctgcgtagtacgggtcggcgacctaacattcgcaccgttcttgctgacatcatgggccttaccaagatcaactacaacgcctgcaactacaatgacggattgcccgtcacgatccgctttgcgagcaaggtgggcgatgtgctg

SEQ ID NO: 20 - protein, 493 aa, Rhizobium etli CIAT 652
MLEFRYGQRMVYPRDGLFLFGPGDGGRAPINFGVIGTPAGVARFRQWMGSVGNVIDAANDDPQHVPFPGYGAAFASAWPDKPRHIIDSIDPAAVSRALRLENRNEAIKSTVDLYVDPLVAAADRLEAPPNFWFVVIPEEIYKLGRPQSSVPKADRIRGSVKLSKSAARDLMLEPTFFPEDLEAAEIYQYATHFRRQLKARLLRDRIVTQIVRETTLAPNDFLNKIGKPLRRLEDPATIAWKILTGAYYKDGGRPWQLADVRPGVCYVGLAYKRQDNSSDDRFACCAAQMFLSSGEGVVFRGALGPWFHSESKQFHLSEDAASSLVEMVIGEYQQMHDGQPPAELFIHAKSSFADPEWKGFKAAAPGTNVVGVQISDAKDRMKLYRPGRYPVIRGTALILHERRAFLWTSGFAPRLDTSQGPETPNPIEVRIHRGDCELETVLGDVMGLTKINFNSCLHNDRLPVTIRFADAVGDVILAAPRTGEPKLPFKYYI

SEQ ID NO: 21 - protein, 471 aa, Novosphingobium resinovorum
MTSQLQHYVRLPEPNLLFHPDRPSDRDIHPLRGLARFGPYSSMFTPSPIRVATLAPSGESQRLFEFLRELNQPARPQERTDYLPDWASFNSVFQTHLAPAASHCRRELDAQLDGELKDCPASGLLLAERLIRSIQLLDANRADFDVLFIYLPERWSPGFYGADDFDLHHQLKAFTAARQLPIQIVREDSALSYRCRASVMWRIGLALYAKAGGVPWKLADVEPDTAYIGISYALRPAESELARFVTCCSQVFDADGAGLEFIAYDTGDVNVQRENPFLSHTEMFRVITRSLDLYRRRHGGRLPTRVMIHKSTEFKEAEIEGCFEALKHIESVDLIQIVEDNGWQGVRWEQDRNDPEISQADGYPVKRGTLLGLSGKDALLWMHGAVDGFGRRPYFQGGKGTPRPLRLVRHAGHGTWDDTAKAALALSKMNWNNDGLYDPLPVTMSYAKTLAQVIKRMPGLGKGTYQFRFFM

SEQ ID NO: 22 - protein, 493 aa, Rhizobium sp. N113
MLEFRYGQRMVYPRDGLFLFGPGDGGRAPINFGVIGTPAGVARFRQWMGSVGNVIDAANDDPQHVPFPGYGAAFASAWPDKPRHIIDSIDPAAVSRALRLENRNEAIKSTVDLYVDPLVAAADRLEAPPNFWFVVIPEEIYKLGRPQSSVPKADRIRGSVKLSKSAARDLMLEPTFFPEDLEAAEIYQYATHFRRQLKARLLRDRIVTQIVRETTLAPNDFLNKIGKPLRRLEDPATIAWKILTGAYYKDGGRPWQLADVRPGVCYVGLAYKRQDNSSDDRFACCAAQMFLSSGEGVVFRGALGPWFHSESKQFHLSEDAASSLVEMVIGEYQQMHDGQPPAELFIHAKSSFADPEWKGFKAAAPGTNVVGVQISDAKDRMKLYRPGRYPVIRGTALILHERRAFLWTSGFAPRLDTYQGPETPNPIEVRIHRGDCELETVLGDVMGLTKINFNSCLHNDRLPVTIRFADAVGDVILAAPRTGEPKLPFKYYI

SEQ ID NO: 23 - protein, 442 aa, Tessaracoccus sp. NSG39
MTLDFDSRQPWAPHTILQEPMLKFDSSPTPATAGHPLVGLLDHGPYAGPPTASVRLATITLNGDKPKLYDFLRGATQAHEPSDRLAYVPRYPGFEALFKAELLPQSDAHVDIRSAEIGTGADAHDRLSEALARAVRHLHTVRDSWDVIVFLLPAAWEPLRLSADGALDLHDRLKATAALLGCPIQMIRETSALQFRYKCSMYWRLSIALLTKAGGVPFRMMRPTESDTAYLGLAYAIRGGTANEFVTCCSQVFDAEGGGFEFIAYNVGADRDLENPHLTRDEMRTVMARSARLYQRRRAGSLPQRLVIHKTTTWREEEVAGVFDAWSPAVPDIECLQVRLDTPWTGVALRGGKGNSAVANEWPVGRGSLQYLSGREALLWIAGTAKGVALTGENYNQAAKALPTPIAFKRDAGAGPLEIPASEILALSKLDWNNDALYGVTP

SEQ ID NO: 24 - protein, 40 aa, Bradyrhizobium japonicum
VEMVFEQVLLRGHIGVVEEDALALYRYLEKKPISPCGARI

SEQ ID NO: 25 - protein, 100 aa, Bradyrhizobium japonicum
LTGAVFAAAAFDAFAGMREHLRATARLLRFDRVVCTLEDEACVADAIPDVGKRPRLLARFVIDTSREIPRDGASSCILRESSPLLLRYSRGAMAVCARAG

SEQ ID NO: 26 - protein, 520 aa, Pelagibacterium halotolerans B2
MTTRPRSFKPQMLYLEEPQLEFRHGQHLVYPRDGLYLYGPVGETKELPTIRYGVIGTPDGVGRFKAWAQSMAGFIDIPPPGPRSRAVEPQHVPFPGFAAAFHADWPVEPPYIIDSLDPDEIEQTLRIANRHEAVRNTVDMFVSRLVAENNRLESAPQFWFVVIPEKVYELGRPKSTVRRDDRVAGEVTISQRRAKELQRQPTLFGEDEREAEVYQYATHFRRQLKARLLKERIVTQIVRETTLAPGDFRRESGMPIRRVEDPATIAWKMGTGAYYKAGGKPWQLADVRPGVCYVGLVYKRSELTSDKRHACCAAQMFLADGEGVVFRGALGPWFQTDTKQFHLDKDAARNLIKMVVGEYTRLHDGPPTELFIHAKSAFTDNEWRGFSSACGDETNLVGVQIAEARDDLKLYRPGEYPVIRGTALQIGERHALLWTSGYVPRLDTYMGPETPNPISVRVLRGECPLTTVLADVLGLTKINFNSCLHNDRLPVTIRFANAVGDVLISAPMDGEPKLPFKFYI

SEQ ID NO: 27 - protein, 409 aa, Agrobacterium tumefaciens
MASLQGSHQPSDRLEYVPPYPGFESLFGIALQSAPAEAHVKWPDAIRDLPGEGNDQVRLFLAMDAALRRLDTMRNEFDVVLFHFPDSWDATTRTKFFDAHDTLKALGAKYNIPTQVLNDRVFAFSHPASRSWRLAIALYVKAAGTPWKLAPLKGVPEDTAYIGLAYALRGDQRDAHYVTCCSQVFDMDGGGMQFVAFEAKDPIADVAEARRNPFLSRDDMRAVLARSLELYQGRNGGTLPKRLVIHKTTAFKPDEIEGAFDALAGVQEIECIEVSPASGWRGVWLVPSGQPKPPTKPAGYPVPRGTVVVRSGTSALVWVAGNAPEVSNKGDYYQGKKSIPKPLQLIRHAGSGPLELSAHEALALTKMDWNNDALYDPVPVSIRYSQRLAKTIANVPDLPRNVYPYRLFM

SEQ ID NO: 28 - protein, 1046 aa, Burkholderia xenovorans LB400
VDALVRSLAVSQDRPLMLFLGAGASMTSGMPSANQCIWEWKRDIFLSNNPGIEEQFSELSLPSVRDRIQTWLDRQRCYPVAGHPDEYGAYIEACFSRSDDRRRYFERWVKQSTPHTGYRLLAELAASGLIQTVWTTNFDGLIARAAVATNLTSIEIGIDSQQRLYRAPGKDELACVSMHGDYRYDRLKNSPGELAQVEVQLRDSLIEALRTHTVVVAGYSGRDESVMQAFRQYAASGPARTDLPLFWTQYGEDPPLDTVSAFLSTNDDEPSRFIVPGVSFDDLMRRLALYLSKGPARDRVNKILDEHATTPVNQLTAFGLPPLPPTGLIKSNAIPLTPPQELLEFDLHQWPASGTVWATLRELGDKHNFVAAPFRSKIYAIAIAESLRLAFGENLKGEIKRVPLNDDDLRYEDGVINQLVRRATVLALSAKANCPSDGESLIWTSEKVENLRLDRVDWKVHQAVLVQIRPLGTEMALVLKPTLYVTDKSGAIAPKDTERLVKQRVLGYQHNKEFNDATEAWRRRLVPQRDFHVRFPDHEDGIDLTFSGRPLFARITDERERTVSLSSAQELAARQAGLQLAEPRLKFARKSAAGLAFDTHPVRGLINNRPFDSSLTTTGIASSIRVGIIAPAQDATRVHQYLSQLHVAAQPGKDADYLPPFPGFASAYQCPLEIPAVGEQSFVQLDEPDSMTPSSARALAGAITRSIASLSASQRPDVTIIYVPDRWAPLRNYMIDDEEFDLHDFVKAAAIPKGCATQFVEEDTLRNTQQQCRVRWWLSLALYVKSMRTPWTLEGLSEKSAYVGLGFSVKRKTTQNAGAHVVLGCSHLYSPNGIGLQFRLSKIEDPIMRNKNPFMSFDDARRLGEGIRELFFAAQLRLPERVVIHKQTPFLREERSGLQAGLEGVACVELLQIFVDDTLRYVASHPTSDGKFETDNYPIRRGTTVVIDDHTALLWVHGASTALNPRRHYFQGKRRIPAPLVIRRHAGTTDLMTIADEVLGLSKMNFNSFDLYGQLPATIETSRRVAKIGALLDRFSEHSYDYRLFM

SEQ ID NO: 29 - protein, 1049 aa, Variovorax paradoxus B4
MSVDAMIRSIGVARDRPLLVFLGAGASMSSGMPSATQCIWEWKREIFLTNNPDVEKTQFSELSLPSVRLRIQAWLDRQRRYPALDHPDEYSTYIGECFARSDDRRIYFEKWVKRCSPHLGYQLLAELARQGLVASVWTTNFDALAARAATSINLTAIEIGIDSQQRLYRAPGEAELACVSLHGDYRYDPLKNTAPELIKQEKELRESLVQAMRTHTVLVCGYSGRDESVMAAFSDAYDAAHFKGHHPLFWTQYGDYPASEPVAGLLASPLDQEPAKFHVPGASFDDLMRRIALHVSDGEARERVRKILENFKTAPVNQKLPFALPSLPVTGLVKSNAIPLIPPGELIEFDLVRWPPSGEVWSTLREIGDRHGFVAAPFRGKVYALATIEQLTQAFADNVKDGAFNRVPLNNDDLRYEDGTANQLMRRATVLALAGKAGCANDGDAIVWDTSRSKTERLDRQLWTVYDAVLLQIRPLGTKLALVLKPTLRVTDSTGEVAPKEIERAVKVRVLGYQHNKEFNQATDFWRKRLLPSRDLLVRFPDLDGGMTFTISGRPIFARLTDERTETVTLNDAQERSASQVGLQLAEPKLVFARTVGTGPATDTLPVRGLLQNRPFDANLTDLGIATNLRIAVIAPARDARRVHDYLGQLHQPIDPTKWDADYLMRFPGFSSAFKCPLDIPQPGQAAFVTLDEPHDESPQSARTLAGRITAALSALRATENPSVTIIYIPARWHALRAFDLESEQFNLHDFVKAAAIPAGCSTQFLEESTLANGQQCRVRWWLSLAVYVKAMRTPWALTGLDRDSAFVGLGFSVRRKIDGEGHVALGCSHLYSPNGHGLQFRLSKIDNPIMLRKNPFMSFDDARKLGEGIRELFFDAHLRLPNRVVVHKQTPFLKEEREGLQAGLEGVACVELLQIFVDDTLRYVASRPMPNGDFEIHGYPIRRGTTVVVDDQTALLWVHGTSTALNPRQSYFQGKRRIPAPLVMRRHAGTSDLMMLADEILGLSKMNFNSFDLYGQLPATIETSQRVARIGALLDRYTERSYDYRLFM

SEQ ID NO: 30 - protein, 493 aa, Rhizobium sp. N871; identical to SEQ ID NO: 22

SEQ ID NO: 31 - protein, 481 aa, Cupriavidus sp. USMAA1020
MDYNLSKAPSFSLLDEPALTFNSEDTDLDENPLRGLLRFGAYNGKTFEGYTPKLRVATIAPASGWPKLKGLVDTIRSGHEASDRRNYVPSFPGFENLFRVPLVAGPKDVHIKWPDDLMALARTGAPHERLFSAMSEAMARLDALHDQFDVVLVHLPDAWATAFTANGFDAHDALKALGARYAIPTQVINDRVFTFRLKASLAWRLAIALFTKAGGIPWKLAPMVGVPEDTAYIGLAYALRGDPKSAQFVTCCSQVFDADGGGMQFVAFEAKEQVADPREARRNPFLSRSDMRAVMARSLSLYLGRNGGRLPRRLVVHKTTSFKDEELQGVFDGLSTVPEVECIEIGSSATWRGVWLKQGKKGGPKSVPDRAPVPRGTVLTRTDRSALLWASGNAPSAALSGALFFQGSKSIPRPLNIIRHAGSGPLEVAALETLALTKMDWNNDALYDPVPVTIRYSQRLARTIANVPDLPGHAYPYRLFM

SEQ ID NO: 32 - protein, 485 aa, Roseomonas gilardii
LSIKSEEDQGLQIADGVPLQFESPLDQAESVPFPPAEVFQRPTFSFDPSGSRNDNWTQRQLDKTGPYDRATFERKRPRIAVICEARRRGAMAETVAHFLEGLPEVQSHKGFVPHATGLLGRFRLQKPQVEFFEAKDDSADAYAEAARNALSAAATRDQPWDLALVQVQRSWKDRPATSSPYWWAKAAFLRRDVPVQALSAEMMAMGDFEYACALANVSLATYAKLGGTPWLLKARPSTDHELVFGLGSHTHKERRRGAGERVVGITTVFSSQGNYLLDARTAAVPFDRYPEALRATLIEAVKRIRQEEAWRAGDTVRLVFHAFTQMRQETADAVVAAVESMGLSGVKFAFLHVAEDHPFTLFDHASATGKGAYAPERGQAVELSDHEWLLSLTGRDQIRAASQGIPDPVLLRLHEKSTFRDMRTLTRQVSDFACHSWRTYERARLPITLLYADEIAKQLAGLERTPGWDPDTAVVGAVMRRPWFL

SEQ ID NO: 33 - protein, 493 aa, Rhizobium sp. N1341; identical to SEQ ID NO: 22

SEQ ID NO: 34 - protein, 493 aa, Rhizobium sp. N6212; identical to SEQ ID NO: 22

SEQ ID NO: 35 - protein, 756 aa, Acidobacterium capsulatum ATCC 51196
LHLNYLPLRFTADIFKGGALTFPEGSEKNWTSDDPISKELSKLREKHGDSHVFHRMGNKIACIPVVENAIAIGTETDFNIISDFQLANALARSALHRYFKAAGRETVIGFRPVTLLLEKHNLASNRKDVFGIFPEYTLDVRPLAPHEGDIASGVLIGFGIKYVFLQNVAELQAQGVSAAGMYAVRLVDESEHQFDRAYLGRIDRFTKDNVTLVDSDYAEYPADQCYFEGSRTNIEAVGRSLLGKDYDAFSSSLLQESYKVTGAPNQTQRLHQLGAWLEAKSPIPCAVGLGVRIAKKPHECSRGNDAGYSRFFDSPKCVLRPGGSLTVPWPVDKQIDLNGPYDAESFPNKRVRIAVICPQEFTGDAEEFLRKLKEGLPNAPDGSPFRKGFVRKYHLSSCDFTFHEVKRSSNSDDIYKDASLEALKQKPDMAIAIIRSQYRGLPDASNPYYTTKARLMAQGVPVQLLNIETIRRKSLDYILNNIGLAMYAKLGGIPWTLTQNSDMAHEIIVGIGSARLNESRRGAGERVIGITTVFSGDGQYLLANNTQEVPSEEYVDALTQSLSETVSELRSRFGWRPKDRVRFIFHQKFKKYKDAEAEAVDRFARSLKDFDVQYAFVHVSDSHNWMLLDPASRGVKFGDTMKGVAVPQRGQCVPLGPNAALLTLSGPFQVKTPLQGCPHPVLVSIHEKSTFKSVDYIARQIFNLSFISWRGFNPSTLPVSISYSDMIVDLLGHLRRVKNWNPETLSTALKERRWFL

SEQ ID NO: 36 - protein, 474 aa, Bacteroidales bacterium CF
MKADYIQEPFLLFGKGKSICPREGIAELNVYDTVIEARKNQLLIGIIGIEEDVENLKSWIKRFESYIPADPKGKQKGLFKSFPGFHQDKGFCAKFIYDSNYERILSPNDIKRILKEPDRNKKVLDAVELFGENIGFLSDIKNCDVIICIIPKSFEGKIVKENKDDEPVEQVAEDNEGPELELNFRRALKARAMKYNTPIQLLREYVMHDSNKSQDNATKAWNFCTALYYKGLQTIPWKLEVDENKPKVCFVGIGFYKSRDKKTIQTSLAQIFNENGKGVILRGTPVTEDKDDKKPHLTYEQSLSLLKDALTKYKFATGSMPGRVVLHKTSKYYEDELDGFIQAMQDLGITEYDIVTIMETDLRFFRNNLYPPVRGAVFSLTEQRHILYTRGSVHQYQTYPGMYIPAPLEVRIVSSVSSIRTVCKEILGLTKMNWNNTQFDNKYPITIGCARRVGEIMKYVGENEYPKESYAYYM

SEQ ID NO: 37 - protein, 124 aa, Rhizobium leguminosarum
MKDLVWVQESSSVKVLRDGNYPVMRGTFVELDGKGLLYTNGSIPYYGTYPGQYDPRPFLLCPHKSSDSTVAQIAKDVLSMTKINWNSTQMNQKLPIPIRAARKVGEVLKYVSDGKVSSDYTRYM

SEQ ID NO: 38 - protein, 517 aa, Acidobacterium capsulatum ATCC 51196
MDLSKKSLKTIHIEEPELSFGHGQTCDHPKDGLFLYGPHSGPTRTREVSVGVIGTKDGLSYFRTWAIAAGGFVPVPPRKKTDKENRLHLSNFPGLEEAFGIMVSPGDFVQRTVDYTVLDDATRTVNQHEAVRKAVDLYVGEIERYDNNEEKTVDVWMFILPEIIFERCKPLSRRTGLGLTKGEFAKSQKERIDLPLFKDVIDQSGEDIFDDVPDFHRQVKARLLKLGRTSQLIRETTLAPDKFLNNAGYPKRGLQDPATVAWNLATGLYYKTQPLPPWKLAHVRPGVCYIGLVFKMIPNDPKEHACCAAQMFLNESDAVVFRGANGPWKTDDFEFHLQPKEAQSLIAKVLKTFEEKHGVPPKEFFIHGCTTFNEDEWKAFKKATPKGTNLVGVRIKETKGESKLFRDGDYPVMRGTAIILDHRNALLWTNGFVPRLDTYIGPETPNPLLITVLRSTGRRPNIRTVLADIMGLTKINYNACNYNDGLPVTIRFASKVGDVLTMGSARDADKQPLKFYV

SEQ ID NO: 39 - DNA, 1482 bp, Rhizobium etli CIAT 652
atgctcgagtttcgctacggccagcgcatggtctatccacgggacggactatttctgttcggtccaggcgacggagggcgagcacccatcaatttcggcgtgatcggcactcccgcgggagtcgctcgcttccggcagtggatgggctcggtcggcaatgtcatagacgccgccaatgacgacccgcagcatgtgccgtttccgggttatggtgccgccttcgccagtgcttggccagacaagccacggcacatcatcgatagcatcgaccccgcggctgtctcgcgggctcttcgcctggagaacaggaacgaggcgatcaaaagcaccgtggatctgtatgtcgacccactggtggcggccgccgatcgcttggaggcacctccgaatttctggttcgtggttattcctgaggaaatctacaagctcgggcgaccccaatcaagcgtccccaaggcggaccgcatccgcggttcggtgaaactgtccaagtctgctgccagggacttgatgttggagccgacgttcttccccgaagatctggaagcggcggagatctatcaatatgccacccatttcaggcgccagttgaaggcacgtctgctcagagaccgtatcgtcactcagatcgttagggaaaccacattggcgcctaacgatttcctgaacaaaatcggcaagccactgcgacgattggaggaccctgcaacgatcgcctggaaaatattgaccggcgcctattacaaggatggtggacgaccatggcagttggccgacgtcagacccggcgtttgctatgtcggcctcgcctataagcgacaggacaatagttccgatgatcgcttcgcctgttgcgccgcccagatgtttctttcgagcggtgaaggcgtcgtatttcgcggtgcgctcggcccatggtttcattccgaatccaagcaatttcatctgagcgaggacgcggcaagcagtttagttgagatggttatcggcgaatatcaacaaatgcatgatggacagccgcccgctgagctgttcattcatgccaagtcctcgttcgcggacccggaatggaaaggcttcaaggccgctgctccggggaccaatgtcgtaggagtgcagatttccgatgcgaaagaccgcatgaagctataccggcccggtcgatatccggtcatccgcggaacggccttgatattgcacgaacgccgcgcgttcctctggacgtcgggattcgccccgcgccttgatacctcccaagggccagagacgccgaatccgatagaagtccgcattcaccgcggagattgcgaacttgaaacggttctcggggacgtgatgggcctgaccaagatcaatttcaattcttgcctgcataacgatcgattgccggtgacgatacgtttcgccgacgcggtgggcgacgtgatcctcgcggcaccacggaccggcgaaccgaagctgccgttcaagtattatatataa

SEQ ID NO: 40 - DNA, 1416 bp, Novosphingobium resinovorum
atgaccagccagctgcaacattatgtccggctgccggagcccaatctgctgttccatccggaccggccgagcgatcgagacatccatcctctgcggggactggcccgtttcggaccctattcgagcatgttcaccccgtcccccatccgcgtggcgacgcttgcgccttccggggaatcgcagcgtctcttcgagttcctaagggaactcaaccagcctgcgagaccgcaggagcgaaccgactatcttccggactgggccagtttcaacagcgtcttccagacgcacctcgcaccagctgcaagccattgtcggcgggaactcgatgcccaactggacggagagttgaaggattgccctgcatcgggtctgctgcttgccgaacggctcatccgttcaatccagttgctcgacgccaaccgcgcggattttgacgtgctgttcatttatcttcctgaacgctggtctcccggcttctacggagccgatgatttcgatctgcatcaccagctcaaagccttcaccgccgcgcggcagctgcccattcagattgtgcgcgaagacagcgcactatcctatcgatgccgggccagcgtcatgtggcggatcggcctggcgctctacgccaaggctggcggcgttccttggaaactggccgatgtggagccggacactgcctatattggtatctcctatgcgctccggcccgcagaatcggagcttgcccgcttcgtaacctgttgcagccaggtcttcgacgccgacggtgctggactggaattcatcgcctatgacaccggcgatgtgaacgtacagcgggagaacccgtttctctcgcataccgagatgtttcgggtcatcacccgttcgctggacctttatcgccggcgccatggcggcagactgccgacacgtgtgatgatccacaaatcgaccgagttcaaggaagccgaaatagaaggctgcttcgaagcgctgaaacatatcgagtcggtcgatctcatccagatcgtcgaggacaatggctggcagggcgtgcgatgggaacaggaccgtaacgatccggagatatcacaagcggatgggtatccggtgaaacgcggaaccttgctcgggctcagcggcaaagacgctttgctctggatgcacggggcagtcgatggtttcgggcgccgcccctattttcaaggtggcaaaggtacaccgcgaccgttgcgactggtccgacatgccgggcatggaacatgggacgataccgcgaaggcggccctggcgctgtcgaaaatgaactggaacaatgacgggctctatgatccacttccggtgacgatgagctacgcaaagaccttagcacaggtgatcaagcggatgccggggctcggcaagggcacttaccagttccgatttttcatgtga

SEQ ID NO: 41 - DNA, 1482 bp, Rhizobium sp. N113
atgctcgagtttcgctacggccagcgcatggtctatccacgggacggactatttctgttcggtccaggcgacggagggcgagcacccatcaatttcggcgtgatcggcactcccgcgggagtcgctcgcttccggcagtggatgggctcggtcggcaatgtcatagacgccgccaatgacgacccgcagcatgtgccgtttccgggttatggtgccgccttcgccagtgcttggccagacaagccacggcacatcatcgatagcatcgaccccgcggctgtctcgcgggctcttcgcctggagaacaggaacgaggcgatcaaaagcaccgtggatctgtatgtcgacccactggtggcggccgccgatcgcttggaggcacctccgaatttctggttcgtggttattcctgaggaaatctacaagctcgggcgaccccaatcaagcgtccccaaggcggaccgcatccgcggttcggtgaaactgtccaagtctgctgccagggacttgatgttggagccgacgttcttccccgaagatctggaagcggcggagatctatcaatatgccacccatttcaggcgccagttgaaggcacgtctgctcagagaccgtatcgtcactcagatcgttagggaaaccacattggcgcctaacgatttcctgaacaaaatcggcaagccactgcgacgattggaggaccctgcaacgatcgcctggaaaatattgaccggcgcctattacaaggatggtggacgaccatggcagttggccgacgtcagacccggcgtttgctatgtcggcctcgcctataagcgacaggacaatagttccgatgatcgcttcgcctgttgcgccgcccagatgtttctttcgagcggtgaaggcgtcgtatttcgcggtgcgctcggcccatggtttcattccgaatccaagcaatttcatctgagcgaggacgcggcaagcagtttagttgagatggttatcggcgaatatcaacaaatgcatgatggacagccgcccgctgagctgttcattcatgccaagtcctcgttcgcggacccggaatggaaaggcttcaaggccgctgctccggggaccaatgtcgtaggagtgcagatttccgatgcgaaagaccgcatgaagctataccggcccggtcgatatccggtcatccgcggaacggccttgatattgcacgaacgccgcgcgttcctctggacgtcgggattcgccccgcgccttgatacctaccaagggccagagacgccgaatccgatagaagtccgcattcaccgcggagattgcgaacttgaaacggttctcggggacgtgatgggcctgaccaagatcaatttcaattcttgcctgcataacgatcgattgccggtgacgatacgtttcgccgacgcggtgggcgacgtgatcctcgcggcaccacggaccggcgaaccgaagctgccgttcaagtattatatataa

SEQ ID NO: 42 - DNA, 1329 bp, Tessaracoccus sp. NSG39
atgaccctcgactttgactctcgccagccctgggcaccgcacacgattcttcaggaaccgatgctgaagtttgacagcagcccgaccccggcaaccgcgggtcacccgctcgtcggactgctcgaccacggcccctacgccggaccgccgaccgctagcgtgcgactcgccacgatcaccctcaacggtgacaagccgaagctctacgacttcctccgcggtgccacccaggcacacgaacccagcgaccgtctggcatacgtgccgcgatatccggggttcgaggcgctgttcaaggccgagcttcttcctcagtccgacgcccacgtcgacatccggagcgccgagatcggcaccggtgctgacgcgcacgaccgactcagcgaggcgcttgcccgtgcggtgcggcacctccacaccgttcgcgactcctgggacgtcatcgtcttcctactccctgcagcctgggagcctctgaggctcagcgccgacggtgcgctggacctgcacgaccggttgaaggcgacggccgcgctgctgggctgtcctatccagatgatccgcgagacctccgcgctgcagttcaggtacaagtgctccatgtactggcggctgtcgattgcgctgctgacgaaggctggcggcgtgccgttccggatgatgcgtcccactgagtccgacactgcctacctcgggctggcctacgcgattcgcggcgggaccgccaacgagttcgtcacctgctgctcgcaggtcttcgacgccgaaggcggcggcttcgaatttatcgcctacaacgtcggcgccgaccgtgacctggagaacccgcatctgacccgcgacgagatgcgcaccgtcatggcgcgcagcgctcgcctctaccagcggcgcagggccgggtctctgccccagcggcttgtgatccacaagacgacaacctggcgtgaggaagaagtcgcaggggtcttcgacgcgtggagcccggccgttcctgacatcgagtgcctccaggtacgtctagacacaccctggaccggggttgccctccgcggcggcaagggcaactcggcggtcgccaacgaatggcctgtgggccgcgggtctcttcagtatctctctgggcgggaggcactcctgtggatcgccggtacggcgaagggtgtcgcgctgacgggtgagaactataatcaggcagccaaggctctaccgaccccgattgcgttcaagcgtgacgcgggtgctggccccctggagattcctgccagcgaaatccttgccctgtcgaagctcgactggaacaacgacgccctttacggtgtgaccccgtga

SEQ ID NO: 43 - DNA, 123 bp, Bradyrhizobium japonicum
gtggaaatggttttcgagcaagtgcttctccgcggccacattggcgtcgtcgaagaagacgccttggcgctgtaccgctatttggagaagaagcctatatcgccctgcggtgccaggatctga

SEQ ID NO: 44 - DNA, 303 bp, Bradyrhizobium japonicum
ttgacgggggcggtcttcgcagccgcggcgttcgatgccttcgccggtatgagggaacatctgcgcgccacagcacgcctccttcgcttcgaccgggttgtttgtacgcttgaagacgaggcctgtgtagcagacgccatcccggatgtcggcaagagaccacggcttctcgcccgctttgtaatagacaccagtcgtgagattccacgcgacggtgcgtcatcctgcatcttgcgggaaagctcgcccttgctgttgaggtattcgcgcggggcaatggcggtctgcgcacgagctgggtga

SEQ ID NO: 45 - DNA, 1563 bp, Pelagibacterium halotolerans B2
atgacgactaggccgcgatccttcaagcctcagatgctctatctggaagaacctcagcttgagttccgccacggtcagcacctcgtctatccccgcgacggcctctacctctatggacccgtcggcgagacaaaagaactgccgacgatccgatacggcgtgattggcacgccggatggcgtaggtcgcttcaaagcctgggcacaatccatggcaggatttatagatatcccaccgcctgggccgcgttcgcgcgctgtcgaaccacagcatgttccatttccgggcttcgccgcggctttccatgctgactggcccgttgaaccgccctacatcattgacagccttgatcccgacgagatcgaacaaacgctcaggatcgccaatcgtcatgaggcggtgcgcaacactgtcgacatgttcgtgtcgcgcctcgtcgctgagaacaatcgcctcgaaagcgcaccgcaattctggttcgtcgtcattcccgaaaaggtctacgaactcggcagaccgaaatcgacggttagacgtgacgatcgcgttgcgggcgaagtgacgatctcccagcgtcgtgcaaaggagctgcagcgccaaccgaccttgtttggcgaggacgagcgcgaagccgaagtctatcaatatgcgacccatttccgccggcaactaaaggcacggctcctcaaagagcggattgtcacgcagatcgttcgtgaaacgacgctggcgcccggcgatttccgtcgcgagagcggcatgccgatcagacgcgtcgaggatcctgcgactatcgcctggaaaatgggaacgggcgcctactacaaggctggcgggaagccttggcagttggccgatgttcgaccgggcgtctgttatgtcggactggtctacaaacgcagcgaactaacaagcgacaagcgtcatgcctgctgcgcagcccaaatgtttctcgctgacggggaaggcgtggtcttccgcggcgcgctcggcccttggttccaaaccgatacgaagcagttccaccttgataaggatgccgccaggaaccttatcaagatggtggtgggcgaatacacccgcctgcacgatggcccaccaaccgaactcttcatccacgcgaagtccgcctttaccgacaacgaatggcgcggtttttcgtccgcctgcggggatgagaccaacctcgtcggtgtgcagattgccgaggctcgtgatgacctgaagctctatcgtcctggagagtatcccgtcattcgcggcacggcgctgcagatcggtgaacgtcacgcacttctgtggacctcgggctatgtgccacggctggacacctatatggggcctgagaccccgaacccgatttcggttcgcgttcttcgcggcgagtgcccactgacgacggtcctcgccgacgtgctcgggctcacgaagatcaacttcaattcgtgccttcacaatgaccggttaccggtgacgatccgtttcgccaacgcggtcggagatgtcctcatttccgccccgatggatggcgagccgaagctgccgttcaaattctacatctag

SEQ ID NO: 46 - DNA, 1230 bp, Agrobacterium tumefaciens
atggcatccctgcaaggatcgcatcagccaagcgatcgcctcgagtatgtgccgccttaccccggctttgaatctttgtttggcatcgcgttgcagtccgcaccagccgaagctcacgtgaaatggccggacgctattcgcgatcttcccggcgaagggaatgatcaggttcgcctattcttagcgatggacgcagcgttgcgacgtcttgacacgatgcgaaatgagtttgacgtcgttcttttccattttccagatagctgggacgcgactacgagaaccaagtttttcgatgctcacgacacactcaaggcattgggcgcgaaatataatataccaacgcaggtgctcaatgaccgtgtctttgcgttttcacaccctgcgtcgcgatcctggcggctggcgatagcgctttatgttaaggcagcgggcacaccttggaagcttgcgcccctgaaaggtgtacctgaggacacggcttacatcggcctcgcctacgccttacggggcgaccagcgggatgcgcactatgtgacgtgctgttcccaggtgtttgatatggatggcggaggaatgcagttcgttgccttcgaggccaaggatcctatcgccgatgtcgcagaagcgcgtcgaaatccatttctcagtcgagatgatatgcgcgcggttcttgctcgcagcctcgagctctatcaaggaagaaatggaggaacactgccgaagcggcttgtcattcataagaccacagcattcaaaccggatgagatcgagggtgcgtttgatgcacttgccggggtgcaagaaatcgagtgcattgaagttagcccagcttccggttggcgtggggtatggctggtaccgagcggacagccgaagccgccgaccaagcctgcgggctaccctgttccgagaggcaccgttgtcgtccggtccgggacctcggcgcttgtttgggtcgcgggcaatgctcccgaagtgtctaataagggcgactattatcagggaaagaagagcattccaaagccgttgcagctgatcaggcacgcaggcagtggaccgttggagctatcggctcacgaggccttggctctcaccaagatggattggaacaatgatgctctctacgatcctgtgcctgttagcatccgatactcgcaacgcttagccaagacgatcgcgaacgtcccagatttgcccagaaacgtctatccatatcggctcttcatgtga

SEQ ID NO: 47 - DNA, 3141 bp, Burkholderia xenovorans LB400
gtggacgccctcgttcggtcgctggccgtgtcccaagaccgtcccttgatgcttttccttggcgcgggcgcatcgatgacttccgggatgccttccgctaaccaatgcatctgggaatggaagcgggatatttttctttcgaataatccaggtatcgaggagcagtttagcgaactttccctcccctccgttcgcgacagaattcaaacatggttggacaggcaacggtgctatccggtcgccgggcatcctgacgaatacggtgcctacattgaagcctgtttctcgcgcagtgacgatcgtcgtcgctattttgaaagatgggtcaaacagtctacgcctcacaccggttataggctgctagccgaactcgccgcttccggtttgattcagaccgtgtggacgacaaatttcgacggactcatcgcgcgtgctgcagttgccacgaatctgacatccatcgaaattggaatagattcccagcaacgactttaccgcgcgccgggtaaagacgaactggcttgcgtctcgatgcacggcgattaccgatatgatcgcctcaaaaattcgccaggagaactcgcccaggtcgaagtccagcttcgtgactcgctcattgaggccttaagaacgcataccgtcgttgttgctggatacagcggtcgcgacgagagtgtgatgcaggcattccgccaatatgcggcatcaggtcccgcgcgaacagatttgccgctgttctggacgcaatacggcgaggacccgcctttggacacggtcagcgccttcctctcgacgaacgacgacgagccatcccgcttcatcgttccgggcgtttccttcgacgatctcatgcggcggttggcgctctacctgtcaaaggggccggccagagaccgcgtcaataaaatcctcgacgagcatgcgacaacgcccgttaaccagctcactgctttcgggctcccccctcttcccccgaccggcctcatcaaaagcaacgcaattccgctgacaccgccgcaggagcttcttgagtttgatttgcatcaatggccggcctccggaaccgtgtgggccacgttgagggagcttggcgacaaacacaattttgtcgccgcgccgttccgatcgaagatttatgcgatcgctatagccgaaagtcttcgcctcgccttcggcgagaatctgaaaggggaaatcaaacgggttcccctgaacgatgacgatctgcgatacgaagacggcgtcatcaaccagcttgtccgccgtgcgaccgtcctcgccttatcggccaaggcaaattgcccgtcagacggagagtcgttgatctggacatccgagaaggtcgagaatttgcgcctggacagggtcgactggaaagttcaccaggccgtactggtccagatacgcccgctcggaaccgagatggcgctcgtcctgaagcccaccctgtacgttaccgacaagagcggagcgatcgcacccaaggatactgagcggctcgtcaagcagcgcgtgctgggctatcagcacaacaaggaattcaacgacgcaaccgaagcgtggcgacgtcgcctcgtgcctcagcgcgattttcatgtccgcttccctgaccatgaagacggtatcgatctgactttctctggacgaccgctgtttgcgcgaatcactgacgagcgcgagcgtaccgtttcactcagttccgctcaggagttagccgcgaggcaagccggacttcaactcgcagaaccacgactgaaattcgcgcgcaaatcggcagccggactggcattcgacacccatcctgtccgaggcctgatcaacaacaggccgttcgattccagcctcaccacgacaggcatagcttcctccatccgcgtcggaatcattgcgcctgcccaggacgccacacgagttcaccagtacctgtcccagcttcacgtcgccgcacagccagggaaggacgcggattatctcccgccgtttccaggtttcgcgtccgcctaccagtgcccgctcgagatccctgcggttggtgaacaatctttcgtccagcttgacgagccggacagcatgacaccctcgtcagcacgcgctttggccggagcaatcacgaggtcgattgcctccttgagcgcgtcgcagcgtcccgacgtaaccatcatttacgtccccgatcgctgggctccgttgcgcaactacatgatcgacgatgaagagttcgatctacacgatttcgtcaaggcggcggcgattccgaaaggttgcgccacacagtttgtcgaagaggacaccctccgtaacacgcagcagcaatgccgcgtgcgctggtggctctcgcttgccctgtacgtgaaaagcatgcgcacgccgtggactttggaaggcctcagcgagaaatccgcctacgtgggtctcggcttcagcgtcaaacgcaagacgacacagaatgcgggcgcacacgtcgtgctgggctgtagccacctctatagcccgaacggcatcggtctgcagttccgcctgagcaagatcgaagatccaattatgcgcaacaagaatcccttcatgagcttcgacgatgcaagacggctcggtgagggcatccgtgaactgtttttcgccgcccaacttcgacttcctgagcgagtggtgatccacaagcagaccccattccttcgcgaagaacgcagtgggctccaggctggactcgagggagttgcgtgcgtagagctattgcagatcttcgttgacgacacgctacggtatgtggcgtcccatccgacctccgacggaaagttcgagaccgacaactatcccatccggcggggaacgacagtggtcatcgacgatcacacggctcttctgtgggtccacggcgcatctactgcactaaatcccagaaggcactatttccagggcaagcgtcgaattccagcccccttggtaattcggcgtcatgcgggcacgaccgatttgatgacgatcgccgacgaagttctcggcttgtcgaagatgaatttcaacagcttcgacctttacgggcaacttccagcgacgatcgagacgtcacgccgcgttgcgaagatcggcgcacttctcgatcgcttctcggaacactcgtacgattaccgtctgtttatgtag

SEQ ID NO: 48 - DNA, 3150 bp, Variovorax paradoxus B4
atgagcgtggacgccatgattcggtccatcggggttgcgcgagatcggccactgctggtgttcttgggtgctggagcttccatgagttccggcatgccatcggccacacagtgcatctgggaatggaagcgggaaatattcctgaccaacaaccccgacgtcgagaagacccagttcagcgagttgtccctgccgtcagtaaggctccggattcaagcctggctggatcgccagcgccgctatccggcactggatcatcctgacgaatacagcacctacatcggcgagtgtttcgcaagaagcgacgaccgccgaatctacttcgagaaatgggtgaagagatgttcgccgcatctcggctatcaactgctggcggaactcgcgcggcaaggtttggtggcatcggtctggacaaccaacttcgatgccttggccgctcgcgccgcgacctccatcaatctgaccgccatcgagatcggcatcgatagccagcagcgtctgtatcgggcgcctggagaggccgaactcgcctgcgtctcactccacggcgactatcgatacgatccgttgaagaacacggcccccgaactcatcaagcaggagaaagaactgcgcgagtcactggtgcaggccatgcgaactcacaccgttctcgtatgcggctacagcgggcgcgatgaaagcgtcatggcggccttttcggacgcctacgatgcggcgcatttcaaaggccatcacccgctgttctggacgcagtatggcgactacccagcatcggagccggtcgccggactccttgcatcgcccctcgatcaggaaccggcgaagttccacgtgcccggagcttcgttcgacgatctgatgcgacgtattgcactgcatgtgtcggacggcgaggcacgcgagcgtgtgcgcaaaattctggaaaatttcaagacagcgccggtcaaccagaagttgccctttgccctgccgtcattgcccgtcaccggtctggtcaaaagcaacgccattccgctcattccgccgggcgagttgatcgagttcgatctggtgcggtggccgccgtcaggtgaagtctggtcgaccttgagagagattggggatcgacatggcttcgtggctgcacccttcagaggcaaggtctacgcgctggccaccatcgagcagttgacccaggcgttcgctgacaacgtgaaggatggcgcgttcaatcgggtgccgctgaacaatgacgatctccgctacgaggatggcaccgccaaccaactgatgcgcagagcgactgtgcttgccttggccgggaaggctggctgcgctaacgatggcgacgccattgtctgggacacgtcgcgatccaaaacggagcgcctggaccgtcaattgtggacggtgtacgacgccgtcctgcttcagattaggcctcttgggacgaagctcgcgctggtgctcaagcccacactccgagtcactgacagcactggtgaagttgcaccgaaggagatcgaacgcgcggtcaaggtccgcgtgctcgggtaccagcacaacaaggagttcaaccaggcgacggacttctggcgaaagcgcttactgccatcgcgtgacctgctagtccgcttccccgatctcgacggcggcatgaccttcaccatctccggccgcccgatcttcgcgcgactcacggacgagcgaaccgagaccgtcacgctgaatgatgcgcaggagcgctcggcctctcaagttggcctgcaactcgccgagcccaagctggtatttgcccgaaccgtcggcactgggcctgcaacggacacgcttcccgttcgcggtcttttgcagaatcggccgttcgatgccaatctgaccgacctcggcattgccacaaatctgcgaatcgcggtgatcgcgcccgcccgcgatgcgcgccgtgtccacgactacttgggccagcttcatcagcccatcgatcccacgaaatgggacgctgactacttgatgaggttcccgggcttcagcagcgcatttaaatgcccgctggacattccacaaccaggtcaggccgccttcgtcacgttggatgagccgcatgacgaatcgccgcaatctgcgcgcacgctcgcaggccgcatcaccgcggccctctccgcattgcgggccacggaaaacccaagcgtcaccatcatctacatacccgccagatggcatgcccttcgagcgttcgaccttgagagcgaacagttcaaccttcacgattttgtgaaggccgcggccatcccggctggttgctccactcagtttctcgaagaaagcactctcgccaacggtcagcaatgccgcgttcgatggtggttgtctctggctgtgtacgtgaaagccatgcgcaccccctgggccctcaccggccttgatagggattccgccttcgtgggcctcggcttcagcgtccgccgaaagatcgacggcgaaggccatgtcgcgctgggctgcagccacctctacagccccaatggtcacggccttcaattccgcctgagcaagatcgacaacccgatcatgctgcgcaagaaccccttcatgagcttcgacgacgcgcgaaagcttggggaaggcatccgagagctgttcttcgacgcccacctacgccttcccaatcgcgtcgtggtgcacaagcaaacgcctttcctgaaggaggagcgcgaggggctgcaagctggcctggagggcgtggcctgcgtcgagttgttgcagatcttcgtcgatgacaccttgcggtacgtggcatcgcgcccgatgcccaatggcgacttcgagattcacggctatccgattcgacgcggcacaacggttgtagtggacgatcagacagcattgctgtgggtgcacggaacctctaccgctctcaaccctaggcaatcctactttcaggggaagcgccgaattccggccccgctcgtgatgcgccgccacgccggcactagcgatctcatgatgctggccgatgaaatccttggcctgtccaagatgaacttcaacagctttgatctctatgggcagttgcccgcaaccatcgaaacctctcaacgggtcgcgcgcatcggtgccctgcttgatcggtacaccgagcgttcgtatgactacaggcttttcatgtga

SEQ ID NO: 49 - DNA, 1482 bp, Rhizobium sp. N871; identical to SEQ ID NO: 41

SEQ ID NO: 50 - DNA, 1446 bp, Cupriavidus sp. USMAA1020
atggactacaacctttcgaaggcgccatcgttttccttgctggacgagccggccctcacgtttaacagcgaagacacagacctcgacgagaacccgctgcgcggccttttgcgtttcggtgcctacaacggcaagacgttcgagggctacaccccgaagcttcgtgtcgcgacaatcgcccctgcatcaggttggccgaagctcaaaggcttggtggacacgatccgatcaggtcacgaggcgagcgaccggcgcaactacgtgccgtcgttccccggatttgaaaacctgtttcgcgttccgctcgtcgcggggccgaaggacgtgcacattaagtggcccgacgatctcatggccctggcgcgtactggggcgccccatgagcggttgttttcggcgatgtcggaagccatggcgcgtctcgatgcgttgcacgatcagtttgatgtcgtcttggtacatctccctgatgcgtgggcaacggcattcacggccaacggattcgacgcccacgacgcgttgaaggcccttggagcccggtacgccatcccaacgcaggtcatcaacgatcgcgttttcacattccggctcaaggcgtcgttggcctggcgcctggccatcgcgctcttcaccaaggcgggcggcattccctggaaactcgcgccgatggtcggtgtaccagaagacacggcctatatcggtctcgcctacgcgttgcgcggggaccccaagtccgcgcagttcgtcacgtgctgctcgcaggtgttcgacgcggacggcggtggcatgcagttcgtcgctttcgaggccaaggagcaggtggcggatccgcgcgaagccagacggaacccgtttctcagtcggagcgacatgcgggcggtaatggcacgtagcctgagcctctaccttgggcgtaatggtggacggctgccgcgacgtctcgtcgtccacaaaacgacgtcgttcaaggacgaagaactccaaggcgttttcgacggcctgtcgacggttccagaggtggagtgcatcgagatcggcagcagcgccacatggcgtggcgtgtggctgaagcagggaaagaagggcggacccaaaagtgtgcctgatcgagcgccggtgccgcggggaactgtcctcacgcgaacggaccggtcggcgctgttgtgggcatcgggcaatgccccgtcggcagcgctcagcggtgccttgtttttccagggaagcaagagcattccgcgcccgctcaacatcatccgtcacgcgggcagcggtccgctggaagttgctgcgttggaaaccctcgcgctgaccaaaatggactggaacaacgacgcgttgtacgacccggttccggtgaccattcgctattcgcaacggctcgcacgtaccatcgcgaatgtgccagatcttccggggcatgcgtacccctatcgcctcttcatgtga

SEQ ID NO: 51 - DNA, 1458 bp, Roseomonas gilardii
ttgtccatcaaatcagaggaagatcagggccttcagatcgccgatggtgtgcctctccagtttgagagtccacttgaccaagcggagtcagtgccatttccgccagctgaggtgttccaacggcccacgttctcgttcgacccaagcggctctcgcaatgacaactggactcagaggcagctcgataagaccgggccctacgatagagcgacttttgaacgaaagcggccgaggattgctgtcatctgcgaggcacgccggcgcggtgccatggcagagacggtcgcgcacttccttgagggtctccccgaagttcaatctcacaaaggctttgtaccccatgcgacggggctgctgggccgcttccggcttcagaagccgcaagttgaattcttcgaggccaaggatgacagcgctgacgcctacgctgaagccgcccgtaacgctctgtctgcggccgccactcgggaccagccatgggatctagccctggtgcaggtccagcgatcctggaaggatcgtcctgccaccagtagcccttactggtgggcgaaggctgcgttcctgcggcgcgacgtgccagtgcaggcactctccgccgagatgatggccatgggcgacttcgagtacgcctgcgctttggcaaacgtcagcttggccacttacgccaagctcggcggtaccccttggctgctgaaggcccggccctcgacagatcacgagcttgtctttggcctcggatctcatacccacaaggagcgacgtcgaggtgcaggggaacgggtcgtcgggatcacgaccgtgttctctagccagggtaactatctactagatgcccgaacggctgcagtaccgttcgaccgctacccggaggcactgcgcgccacgctcatcgaggcggtcaagcgcatacggcaagaggaggcctggcgcgcgggcgacacggtgcgcttggtcttccatgccttcacccagatgcgacaagagactgcggatgccgtggttgccgctgtggaaagcatgggcctgagtggggtgaagttcgccttcctccatgtggccgaggaccacccattcacgctgttcgaccacgcctcagcgactggcaagggtgcctatgcgcccgagcgtgggcaggccgtagaactcagcgaccacgagtggctcctttccctcaccggacgggatcagatcagagccgcgtcgcagggcatccctgatccggtgctactccgcctgcacgagaaatcgacctttcgcgacatgcgaacgctgacgcgtcaggtatcggatttcgcctgccactcctggcgtacttacgaacgagctaggctcccgatcacactcctctacgccgacgaaattgcgaagcaactcgcaggcctcgagcgtaccccgggatgggaccccgataccgcagtagttggcgcggtgatgcgcaggccttggttcttgtga

SEQ ID NO: 52 - DNA, 1482 bp, Rhizobium sp. N1341; identical to SEQ ID NO: 41

SEQ ID NO: 53 - DNA, 1482 bp, Rhizobium sp. N6212; identical to SEQ ID NO: 41

SEQ ID NO: 54 - DNA, 2271 bp, Acidobacterium capsulatum ATCC 51196
ttgcatctcaactacctgccgctacgttttactgccgacatattcaaagggggcgctctgacctttcctgaaggttcagaaaaaaactggacctccgacgacccaatcagcaaagagttgagcaagttgagagagaagcatggggattcccatgtttttcatcgaatgggaaataaaatcgcctgcatcccggtagtagaaaacgcgatcgcaattggcactgaaacagacttcaacatcatctccgactttcagttagcgaatgcgctcgcacgctcagcattacatagatatttcaaagctgctggcagagagactgttatcggctttcgccctgtcacgctcctactcgaaaaacataatctcgcttctaaccgcaaagacgtatttggcattttccccgaatacacgctcgacgttaggccgttagctccgcacgagggggacatcgcgagcggagttcttattggatttggaatcaaatacgtcttcctccagaatgtcgctgaacttcaggctcagggtgtttcagcagccggcatgtacgccgtgcggttagttgacgagtccgaacatcagtttgatcgggcctacctcggacggatcgaccgcttcacaaaggacaacgtaaccctagtcgattctgactatgcggagtatccagccgatcagtgctatttcgaaggtagtcgtacaaatatcgaggcagtcggccgaagcctccttggcaaagactacgatgccttttcgagctcgcttcttcaggaaagctacaaagtgaccggcgctcccaatcagacccagcgactccatcaacttggagcctggttggaagcaaaatccccaattccgtgcgccgtcggcttaggagtgcggatcgctaagaaaccccatgagtgttcacgaggcaatgatgccggctactccagatttttcgactctcccaaatgtgtccttcgccctggaggttcgttaaccgttccttggcctgtcgacaagcaaatcgacctcaatggtccttacgacgcagagtcatttccaaacaaacgggtgcgcatcgccgtcatctgtccgcaagagttcaccggggatgccgaagagtttttgagaaagctgaaggaggggctacccaacgctcctgatggatcgcctttccggaaaggtttcgtccgcaaataccacttgagcagttgcgattttacgttccacgaagtgaagcgcagttcgaattccgacgacatttacaaggatgcttcgttggaggcgttgaaacagaagccagacatggcaatcgcaatcatccgttcgcagtatcgagggcttcccgatgcgtcgaacccgtactacaccactaaagcgcgattgatggcgcaaggtgttccagtacaactattgaatatcgaaaccatccgtcgaaaaagccttgactacattctcaataatatcgggcttgctatgtacgcgaagcttggcggaatcccttggacgctgacccagaacagcgatatggcgcacgagattatcgttggtataggaagcgccagattgaacgaaagccgtcgtggtgcaggcgagcgggtgatcggaattacgaccgttttcagcggcgatggccagtacctgttggcaaacaatactcaagaggtgccttcagaagagtacgttgatgctctgactcagtctctctcggagactgtgagtgaactcaggagccgattcggttggagaccaaaagacagggtccgattcatcttccatcaaaagttcaagaagtacaaagatgctgaagctgaggcagttgatcgcttcgcacgatcactcaaagatttcgacgtgcaatatgccttcgttcatgtcagtgactcgcacaactggatgttgctagatcccgcatcgaggggagtgaagttcggcgacacaatgaagggagtggcggtcccgcagaggggacaatgtgtgcctctagggccaaacgctgctcttttgactttgtccgggccatttcaggtcaagacgccactgcaaggttgccctcatccagtactggtgagcattcacgagaagtccacgttcaagagcgtggattatatcgctcgccaaattttcaatctcagcttcatctcatggaggggtttcaacccgtcaacgcttccagtttcgatttcttactcagacatgatcgtagatctgttggggcatttgagaagggttaagaactggaatcccgagacgctttcgaccgcactgaaagaaaggcgctggttcctatga

SEQ ID NO: 55 - DNA, 1425 bp, Bacteroidales bacterium CF
atgaaagcggactacatacaagaaccttttttattatttggcaaaggcaaaagtatttgtcctagagaaggtattgccgaattaaatgtatatgacacggtaattgaagccagaaaaaatcaattgctcattggcataattgggattgaagaagatgtagaaaatctgaaaagttggataaaaaggtttgaaagctatattcctgcagatcccaaaggcaaacagaaaggattgttcaaatcgtttccgggattccatcaggacaaagggttctgtgcaaaattcatttacgattcaaattatgagaggattctctcaccaaatgacattaaaaggattttgaaagaacctgataggaataagaaagtattggatgcagtagagttgtttggtgaaaacattggctttctctctgatattaaaaactgcgacgtaataatatgcatcataccgaaaagctttgaaggtaaaatagtaaaagagaacaaagatgatgaaccagttgaacaagtggctgaagataacgaaggacctgaattggaactgaattttagaagagcattaaaagcccgtgcaatgaaatacaacacacctattcagttgttgagagaatatgtaatgcacgacagtaacaaatcacaagataatgcaactaaggcatggaatttttgcactgctctttattataagggacttcaaaccattccttggaagttggaagtagacgagaacaaaccaaaagtatgttttgtaggtattggattctacaaaagcagggacaagaaaacgattcaaaccagtttagcacaaattttcaatgaaaatggaaaaggtgtgatacttcgcggaactcctgtaactgaagataaagacgataaaaaacctcacttaacttatgagcaatctttaagccttctgaaagatgccttgaccaaatacaagtttgcgacaggttcaatgccaggtagagtagttttacacaagacttcaaaatactatgaggatgaacttgacggctttattcaagcaatgcaggatttgggtataactgaatacgatattgtaactatcatggaaaccgatttgcgtttctttagaaataatctttatccaccagtgagaggggcagttttttcattgactgaacaaagacacatactttacactaggggttcagttcatcaatatcagacatatccaggaatgtatattcctgctccattagaagtaagaatagtaagttccgtttcatctataaggacagtttgtaaagaaattcttggcttgacaaaaatgaattggaacaacacccaattcgacaacaaataccccattacaattggctgtgcaagacgggtaggagaaataatgaaatacgttggagaaaatgaatatccgaaagaatcttatgcatattatatgtga

SEQ ID NO: 56 - DNA, 375 bp, Rhizobium leguminosarum
atgaaggaccttgtatgggtccaggaatcctcgtcggtgaaagtcctccgcgacgggaactatcccgtgatgcgcggcacctttgtcgaactcgacgggaaagggcttctctatacgaacggcagcatcccgtactacggaacctatccaggccagtatgatcccaggccatttctgctatgtccgcacaaaagcagcgacagcaccgtcgcgcagatcgccaaagacgtgctgtcgatgacgaagatcaactggaattcgacccagatgaaccagaagctgcccattcccatccgggccgcacgaaaggttggtgaggttcttaaatacgtcagcgatggaaaggtcagttccgactacacccgatatatgtga

SEQ ID NO: 57 - DNA, 1554 bp, Acidobacterium capsulatum ATCC 51196
atggacctgtcgaagaaatccctcaagactatccacattgaggaaccggagttgtctttcggccacgggcaaacttgcgaccacccgaaagatggactgtttctctacgggccgcactctggcccaacacgcacgcgcgaagtttccgttggagtcattggaacgaaagacggactctcgtattttcggacgtgggcgattgcggctggcggctttgttcccgtcccgccgcgaaagaaaaccgacaaagaaaacagattgcacctctcgaattttcctgggttggaagaagcgtttggcatcatggtcagcccgggagactttgttcagcgtactgtcgattacacggtactcgacgacgccacccgtacggtgaaccagcatgaagcggtacgcaaagcggtggacctctatgtgggagaaattgaacgctatgacaacaatgaagaaaagacggtagacgtttggatgttcattctccccgaaatcatcttcgagcgttgcaagccgctatcgcggcgcaccggccttggcctgacaaaaggcgaattcgccaagagccagaaagaaagaattgatcttccgttgttcaaggatgtgatcgaccagagcggcgaggacatctttgacgacgtgccagattttcaccgccaggtgaaagcgcgtctgctcaagctaggtcgcacttcgcaactcatccgcgaaacgacgttggcacccgacaaattcctaaataacgcgggctatccaaagcgtgggttgcaggatccggcgacagtggcgtggaatctggcaactggactttactacaaaacccaacccttgccgccgtggaaactcgcgcatgtcaggccgggcgtttgttacatcggacttgttttcaagatgattccgaatgatccaaaggaacatgcctgctgtgcggcgcagatgtttcttaatgagagcgacgccgttgttttcaggggcgcaaatggcccgtggaaaaccgacgactttgaattccaccttcaacccaaagaggcgcaaagcctgattgccaaagtgctcaaaaccttcgaggagaagcacggtgtgccaccaaaggaatttttcatccacgggtgcacaaccttcaacgaggatgaatggaaagccttcaaaaaggccacgccgaagggcaccaatcttgtcggcgtccgcatcaaggaaaccaaaggggaatccaagctgttccgtgatggtgattatccggtaatgaggggaacggccatcattcttgatcaccgaaacgccttgctgtggacgaatggatttgtgccacggctggacacctatattgggcctgagacgccaaacccgcttttgataaccgttctgcgtagtacgggtcggcgacctaacattcgcaccgttcttgctgacatcatgggccttaccaagatcaactacaacgcctgcaactacaatgacggattgcccgtcacgatccgctttgcgagcaaggtgggcgatgtgctgacgatgggttcggcacgcgacgcagacaaacagcccctgaagttctacgtctag

SEQ ID NO: 58 - DNA, 187 bp, Streptococcus pyogenes
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacg

SEQ ID NO: 59 - DNA, 2262 bp, Artificial Sequence
  Description of Artificial Sequence: Synthetic polynucleotide
atgcccaaaaagaaaaggaaagtggaagacccaaaaaagaaaagaaaagtcggatccggatccatgtctatcttcgcaaattcatttgaaattgaggttcccacactgcccgccgaaatatataagatcgatccacagccgtccgagagcgacccctggagggcactggattcctatgaggaaagcatagaacggacttgccgcggtagcgcccaccgcattaaaaattctggtgactgggccatcttgtccatcgctgccacggatagtcaagatgagcttcaggggccagacgggacccgcctggttaggactagcgagaccacagtggggggtgagaacggaagataccaaagcgccgtgaaacaagccctccgcaacagcctcgagtggttcgtaacaaaccacctcgacttttgggagagggggaatagccaggcattctacgaatgggacccaagcaatacagtgggaatgtatgacgcctatcacggctacaaagctaccattgattataacgatgggtactatctgacagtggactctaccgtgaagtttattagctccaaatccatcaacgagtacctgtcagagctcgggcgagacgtagtgaagactcgcttcttcgacaggtattgcacactgatgtcagacagccgccccagcgttgagctcgtatccctggcagaggatttgacggtgagtgacaagaccatgaacttcggtgggaaggagatgtccgtgattgactatatcaaatctgacgacaagtactctcaggaggcattcgatgctattgaccctgatgagccgcttgcccgcgttagattcccgtggagcgatgacccagttgatacagccccgtcactgctgcaccctctccctaacggtatcgaacctaaaatgaccggttatgccgccagaagtgccgacgaacggtggcgcgacaccgaacgctttgctaagcggattgattacgttcaggtgtttgacgaacagtgtaacgtctccgatgaaccaagaaggggcggttctgtccacgattatccgtctctcaagttcggcggcaccgaagttcttaacctggggcagcagaatccactcaataccgaccagaccgtgaatagacagaattggaggtatctggtgcgcgacttcctggaggagtacggaccagctgtgagacaacggggcgctgcccagattgatgttgttcatccggacggtcgaagcgatatggcagcagagctctttgccaatctgtctaaatacctggagaattttgtggggattacggtgcgggaccagcccggtattgtgtcccatagcgactaccagaagctgcgagaatggagagaacggcacgctgaggatagcgatggaatcttggtacttcaggaggacggttcagataggtaccttgacatcgtggcggagctggaggggaaccctacacaggggattaccgttggaacatatgaatcatcacttaggagcagtgggttcgatgacagcatgtataatattgcctgtgggctcgccaccaaaatgggagtcagaccttttctgctcgatcaacctctgaatgccgatctgtttctcggtatgtcagtgaccggagacgaagtcaacaacgccacagctgttttggtgtccggagaggatggggacttgattggccagacccagacgaatctggccaccggcagtagcactgtgacaggaaaggatgttgcagctaggatcgttaggcagcagatcagtgccgccatcgacagaaatcaacttggatacgtaggaagcttgacaattcatcggaatggtcagtttggggacggcgagctggagggcatcagagagggcatcgctgaactccagtcctccggtgatctcaacgaagagttgacttggcaagccattgaaatatctgatggcagcagccatagactgtacactgatgactccggaagtatggtgcagacgggcagtgtgatgccactcgacgataagagcgttacagtggttactttcggctccccacacatccatcaggcaacccctgacccactttattgcaccattgctgacggagagggagaaactgatatcaacctgatcggcactgacattctgtccttgtcctttttgaattggggctccccaatgatgaagatgaagcaaccactgaccacatacttgccagccgagatgcatgacattctgtcaaccggaactcaactgaatcaccctcctttttagtaa

SEQ ID NO: 60 - DNA, 2556 bp, Artificial Sequence
  Description of Artificial Sequence: Synthetic polynucleotide
atgcctaaaaaaaaacggaaggttgaggatccgaaaaaaaagcgaaaggtgggcagcggctctatgagcgattttgaccctaatgagaaacagggaagactgatcgagagcaccgatggcttgcaccttgttgatgcaggagcaggtaccggcaaaactttcactgtaacacggagatacgccacaattgtcgaacagtctgacgtggatcctgctgatattctcttggtgactttcacaaacaatgccgccgccgagatgaaagagagaattgtgtcccagtccgaatatgggatgcgggagcttaccgacgctcctattcagaccttccactccctggcaaacgacctgttggaggagcatgggcacgctgtgcctacgtatctcggtatagatgataggatcacagggtctacacagatcctggaggatgagcttgtcgaggaggcactgtttgacgaattcatagggcagttcatggacactaacccagagtataacagtttcttcactgctatcagtgatactacggaactcctggacctgatcaaggagctggcagctaaaggtgttttccccaccgccaaaggctggtacagggacggtgaatcccacctggacggcgacttcgaggcttttgaagacctcttcgaagaaataaatgaaccaagaaacggcgggtccaagcagtctagactcagggccaaactgaataagtacggagagaataaagcttatctgcccgaggcaccagagagatgggaaatcagagacggcggcaaacaggtcccagataccgtggctaggcgcgttttcgaggaagacagggaggagttgaagacattcattcacgacatgtaccacgcttatctttccttcgctctgaggagaaattacctcaatttctctttcttgcagctgttcgcttttgtactgctgtgtgaggaccacgaactgcgggaggagctgggctatgaatatgtaatggtagatgagttccaggacagtagcgagatccagtttaagctcactctgctgttggcaggtaccaacaatatctgtgtggtaggggattggaagcagtccatatattcattccaatacgccgacgtcgataacataagggaatttgaaactcgcctggaacgctttactacagaacttaataatgactatgacaggatccagtaccccacaactcccgtgaccaagctggaactggacacaaactaccggtcaacccagtcagtactggactttacggaacacgcactgacgacacctgccacatccagcgagtcagttgatgtggatgccgtgagggagaagattacctccttgaccgctgacgctgattacgataacagtatcatcgaagctatcagatccgataaagagcacgaggccattttgacgaaaatcgatgaaatcaccggaaatgaaagctatgctgtcgagaaggacggggaacttagagcccccacctattcagatatcgccgtggtaacacgcactagggattttggcagagacttgttggatgttgcagaggaatgtggccttcctatggcttatgagggcgggatcgaggtctttagaaccgacgcggcaaaactgctgctggcttggttcaggatactcgagcgagacgctgatcgagggtgggctttggtactcgaggaagcgggatatactatagacgagagcaaagccgtgctgaagaacgaggcctacccagagatgatgataggcttcagagaggagcttaggaagctggagaccttcggaggggttgcgcgccgggtgttcgagcggtatggctgtgaaggtcctaccgctgatgtggtcctccatactgtgcagtctgtgtatgaggcgaccacactgactcgcggggacctgatccggttcatagaagacgccattgagtccggaagcacacacgaagtccaggccggcgcaggtactaacagtgtcacagttcagactattcacgcaaccaaaggcctcgagtacccaatcgtgattctggcgaacatgaacaccaataagtttccatccagtggtggatccggcaccgatatctcatacgacgatcccatcggtttgagaagacgcaaactgtacagtgaggttgcccatggggtcccatacgtgtatgacaattggaaactggacgtgctgagacgctgtctgccccgcgaatatgacgaggagaggaggctcctgtacgttgctattacacgggctgaaaaccacgtggttttcactgctggtgagaatcctaacactttcctcgaagaactgcctgtggatgtcgaagcggtcaatccggacttgtcaagtttcacacctgaaccggtcgacgagagcccattcgaggtcgagatctctgcctcagaagggtctccgcgcttttcccctcatacgtttatcgatgacgctgtgtttgacgacggaacagggggaagaggtatggagttcggttctcaggtgcacgacttcgctgaggcatatgtgcttggggaagatgtcaccagttcctccccttagtaa

SEQ ID NO: 61 - DNA, 2634 bp, Artificial Sequence
  Description of Artificial Sequence: Synthetic polynucleotide
atgccaaagaagaagaggaaagtggaagacccaaaaaagaaaaggaaagtgggatcaggctctatgcacgatgatcacgacaccgaccactcccagactgacctgacaactaaccccaaggacaactctaacaacggggatattgacatcgagactgacattctccagcttacaggggaggacctcgaatctacctaccctaacaatcggtacttcgggcaggttcacgaaaacttcgaaatacccgctagagaagagcagacagttcccgctggcgacgtgcttcctcctaaaattgcgcaaaacctggagttcaacccctggtcccatcaggcggaagccttgcaggttctggatcggggcgacaacgtctgtgtggccacctcaacttctagtggaaagaccttggtgtacggtctgcatatcgccagacagtatttggaagaccccgaaacacgcagcctgattgtctaccctactaaggctctgtctagagaccaagagcaggaattgaacgaattcctgcgaaacacgttggggctcgacatttccgttggcgtgtacgatggggacaccaaatcagaagagaagagccggatcagggatgaatgcaacgtggtgataaccaactttgtgggcctcaatcagtatctggaaagccaccacctgtgggcagacttccacagcaactgtagtctggttgttattgacgaagcgcatatgtggaccggcctcggaggtatgcatgtagcctggattttgaggcgagcccagcggataattgactactatggaggcgatccacagtatgtgctcactaccgcaacgattggcaacccaacagaacacgcattggctctcacaggcgagccggctgcggtcgtcgacgaggatggaagcccacgcggaattcggcatcttgttttttgggacccaccaatgagcggggatgacggattcactgatgatatagactccccagctctgtccaagcgaccagcaacagtggaggcacctgaagtttgggctcatatgtgtcagaagaacgttcaaagcctcctgttttgtgacagcaggaagctgacagagttgagcgtgaatagggcgaagagatttatatcagatcctaaaaatcggtatcaaggacggccagaccttgcttcatatcatgctggacatggaaagcaatcccggagagggacagaataccagcttaaggaaggccaactcgacggggtgtcaacgacatctgccttggaagtcggcattaatatcgggggggtcgacggcaccgtcttgatgggttatcctgggtctcgacaatcattctggcagcgcatcgggcggagcggtagggggacaagagacgcgctgtctgttttcgtgccctcccactcaaccttggatcagtatatcctgagacacccagaatatgtcctggaagaggatcacgagtctgccgtagtggatttggacaacaacccagtttatttgcagcagttgaattgcgcagcccaggaattgcccctgacacgggatgacgctgaagacttcggaggggaagaacgcttggagcgggcagtcgaatatggcaggagaaagggtgaccttgagggctccctggacagtggagttatgtacgcacaccgcgatcggcctcaggacgcaatctccctttatagctcaggaggtaacaccttcgacgtgcgactggcaggtgatggatctattgatcatcagcccatcgggagggacagggcatatcgcgattatcacgagggggccacagtgcttcaccagggcgagcagtaccaggtggttgaactgagggaggacataccccaaccttacatttcacttgaaaaagcgaatgtgagttattacacccagtcacaaggacaggtaaatatatatgacactgttgtggaagatagtagagaggtagggccgtttacgcttaactggggatacgggacagtttctatccactattccacttacctcaagcgagagattggatctggcgatgtgttggagcttgggaacgagaccggggtgcctccgctcgagatgagaacccagctgtgctgggccgaaacccctaatgacatcgagagagccatgttgaacaagcatagtgagtatcataaccccgagtgtattaacctcccacctcggctgcacggctatctcggaggtattcatgctgttgagcacgctatgatcgccgtctctccactcgagttgaaagtggatggcggagatatcggcggcctggcgacaaaccgcctgcccggcaatcctgacaagtcagggtggttcatctatgatggaatcgaaggaggattggggttctctaggagtatttatgagcactttgaagatgtcgctcgaagagctcatgatctgattgttgactgttcatgtggtcgggacgagggatgcccagcatgcacaatggatgatcgctgcggcaatgataataggccactgtattcaccagctgccgccgacgtgattgagcatctgctcggcgatcaagaggaggacgacctgaacgagcacctccccgagacagggtctgaagtaactcctgtggaggaacaacgcccacctgcatcaatatcttagtaa

SEQ ID NO: 62 - DNA, 2451 bp, Artificial Sequence
  Description of Artificial Sequence: Synthetic polynucleotide
atgcccaaaaagaagagaaaagtggaggatccaaagaagaaaaggaaggtggggtccgggagcatgtccgagctggagactaacatcttcccgattactaacctgcacgagttggagtcccgctttaggctgtacagggttagagggttgagcattaatcaggaagaatacgatcccaatacccagaccttggttcggaaacttagttacagtatgaggtcaccggttgccgtaatcctcagaaacagcgacccgttccttgccctgcctatcgatgctccagaaccgatctccccctatccacttgtgcgagctaccgccgttttcgagaaaacggatgaagtctttacgttggattacgaaagccctactcctgaaactgatgcactgaggatccgctttcttcaattcataattcaaggagctcttttcaggaatcccagtctgtggcagccctcagcagggacaccctttttcgaaaggagcccggtcctggagaaggcagggatttgcgcataccggggcttcagtgtacgggtcgtccccattgaggggggtaagctggggatatgcgttgatgtcaagcacagatatgtgtctaagaaccccatagaagccaatattaagcgggaagagtttcgaaagtacaaaaatggccgatgtatttaccactatggacacaactggtatgagattaagcttcaggaccatactgggttgagcgtttccgaacaaatgatttcaaatggcaccgccaagccaatttccctgtaccagttcatcatgaacaatgctcctaagcctctccctcgcgaagtgatagacatgcccccagactctcccgccgtcaagtacatgacctctcgcgatgaggtcagatatgtaccatctattctctgttacccagtgttcgacacatcagacccacgcgtgaaacctacccatcgcggtaccatcctgctgcccaatgtaaggagacagtacattcataattttgtgaattcccacctgacggacgtgagaagcaaggatatggccatcaggatcagctctaagccagtgatcgcccccacaaaaatcttcttgcccccagatctggcgtttggtaacaacaccgtgttcagcgtccggggtactcccgggacgacctacgtgagcctggagcagctcggccagacaaggatttcagctctcttcaaccagaaaattgggccctacgatagtagacctctcgacaggcagtatatgatacttcccaagtccgtctgggactcacacgggcccgtcttcctgaacgactttaagaagattatgaatgaactgtacttgcacgaacttccttataaccctattgtggtgacctataatgatctgagtgctaagacttacgcgctgcaggggagggcaattctcgacgccgtcgatagcgaattgagggagccaggctacggcgtcgtcatgatacatgaaacagtggatagaagaaatcgccagcatgatcaactggccgccatggttatgagagaacttaggaaccggaggctgtacgtgagcgtgatccacactacagtgaccaaagactgttaccagctgcctcaaaacgctccgataggcaaggcctactgccctgtggccggaaagcagggtaaactgaacggctatctgaggaatgtggccataacaaaagttctcctcacaaacgagcgctggccttttgttataagtaccccacttcatgccgacttcaccgtggccttcgacgtgcagctgaataccgcctgcttcacatttatcgggaagagcgggagtgacatccggacagttctcaagaccagcaaccaaaaagagcggttgagtaaggctcaggtgcggcaaacactgttggaggtgctgcgccaggaggtcggctttggaaggcgcaccatgcagactatagtggttcaacgagacggcaagctgtttgctagcgagatcgcaggggcgaaagatgccatcgaaattgttaaaaaagagggcattctgcccagcgacgtctctctgaacttcattgaaatccctaagagcagcgtggctccttttcgactgttcgattcctctcctcggccgggacagccagaaatggctaacaacccacggataggatcatacttcattgccacaaactacgacggctacatctgtacaacagggaaggaattttatcatcctggaaccgctaatccactccatgtcaagtatatcgaaggtaatatgcctttcgagaagattcttgaggacgtgtacgcattgacatgtctcgcgctgacccgccccgaggactgcactcgcgagccattcacaatgaaactcgccgacatccgactgcgggaacacgcaggagggtacgatgaagacgcgctggcctacgatgacgaaaacgaaaatgacgaggataatgaaaatgagtagtaa

SEQ ID NO: 63 - DNA, 3051 bp, Artificial Sequence
  Description of Artificial Sequence: Synthetic polynucleotide
atgccaaagaagaagcgcaaagtcgaagacccaaagaagaaaaggaaagtaggttcaggctccatgacgttcaccgaatacaagacggtggaaaaagagatcctggattgtctgcaaactgcggagcttggctggaggtatgaaccgggggatgaagtgacacttaagtaccggggcggggatgagcaagagatgctccttatacccatactgcgagagaagctgaaggaactgaaccatggagtgatcaccgatgacgagcgggccaatattattattcagaagctgagggccttgaaagacaaccaagagtggattaaatggatcagaggggagaaaacctacaagttcagccaggatgaaccaagcaggaatataaacctcattgactacacaggtgtgggcaacaacgacttccttgctagcaaccaggtttggattcagggaatcgagcacaggagaccggatatcctgctcttcgtaaacggaattcccgtggtggacatcgaggcaaagactgcctctcacggccatattgattgggctgaaggcgccaagcagacggggagatatgacaaagaaatacccaatctctactactccaactgtttctgtgccggagtgaatgagctgcgaatgaagtatggtattcctggagaacgactccaatactggcagcagtggagagacccttacccacacacccacattcctagttttgacgagatgaagtgtacaatctatggtcttttcgaccggaccaatttgcttgatattattcagaacttcattgtcttcgaaactgaacagagcaagactatcaagaaaatagctagataccagcaattccgcgccgccaataaaatcgtggctagagcactcaaccttgatcaggaaagtggtcaacggcggggcatcgtgtggcatacacagggcagcgggaagtcattgacaatgttgtttgccgcccgaaagttgtggaatgactccaaacttaagcaacccactatcattattgtggtggatcgggagcagctgcaggatcaaatgatcggtgagttgttcaagaccaattcagaaaacgtcgccgtagccgtctccatccaagacctgcgccgactcgttgcagagggcgacggttaccggggcatcatcgtgaccatagtaaacaaattcgagggcatgcagatcgaaatcagcaaacgcgctaacatagtcatgctcgtggatgaagctcataggacccagtacggcgatctcgggatcttcatgcggtcagcgatgcccaatgcaagtcttttcgggctgacgggaacacctctcgaactcgacgatcggaatacacccagagcgtttggccgcaaactcggggaagacagattcgaaaggtacatggacaggtattcaatcgaggattcccttagagacggcgccacgcgccctatccattacgaggtccgcgcgaccgattggacggtcgcttacacagaccttgacaaaaaatttgaggctttgttcgctgatcgctctcctgaggaacgaaaagcgctgatgggcgaggctaaactcgacgccatcctgaaacaccctaaacggatagcacaggtggccaatgatattgctaatcatttcatcgaacacataagaccgaacggatttaaggcaatggttgtgtgcagggataaagagatgtgcgcgctctacaaaactgctctggatcagctgctggcaccggaagtgagcctgatcatcatcagcgaggaccccactcatgacgtcgacagtatcaaaccgtactaccttggagacacacaaagaagaaatgccgtcgacgacttcaagaaccctgcccccaaatcccaagaagaaagggataaccccgataacagatttaaaagggtggagatactgatcgtgtgtgatatgctgctcaccggattcgacgccccgatactgcaggtcatgtacctcgataagtccatgagagatcatacccttctgcaggctatcgccagggtaaatcgcccatactctgagttgaaggagttcgggctgatcctggactattttgggatgttcgagaaactgaatgacgcactcaactacgataaaaacgagcttggggaagtggcctttccttacggtaaattcagggatatgttcagaaccaatataacggaattgctggacctcttcatcgggatcccacacgatggctcccaccagagtgcaatgcgcgttctgattatgttgaacgacaacgatgagaaacgcgaacagttcgagaagctgttccgcaatgttagggtgcttttcgagactctgcagccagacgaattcttgcgagactttctctatgattatgagtggctgtgcaaactgtacatgatctaccttaaaaagttctatccagcagagcactttgagataagcgaggaggacggggcaaagaccagacagctcattcgagagcacgtggatgttaaggagatcgaggaggagttcccgacctacaagctggatgaaaactacttgactaaaataaaagatatgaatcccaatgccaaagcactggacatcgaggcaatgttggacgctgagattaggatcaggctggatgaggacgaagacgtgcgcccactgtctgagcgccttaagcatataattgagcagaagcgggcaggaactctcgcagggataactctgcttaaagagctggaggatttgacaaagcaggtggtcgatgtaatccaagaaacccagcgacctgtggtggactctattgcaaaggaggtcgcgaagcgcgtaccgaatatcccgcagggcgaagcaatggctgttgcccaggctatcatagctaaggctaaggagaaatgcttcgagaactggttcttgcagaactatatggacactgagctgtaccgcgagttcaccattttgcttgcaacacagttcaagaatctgcagctgcacggtgcaggcaaagatttcgtagagaggtgtatacgcctcttgaaaaaggcgaggtttgccggaaaggataagtagtaa

SEQ ID NO: 64 - DNA, 2586 bp, Artificial Sequence
  Description of Artificial Sequence: Synthetic polynucleotide
atgccaaagaaaaagcggaaggtcgaggaccctaagaaaaagagaaaagtgggctccgggtcaatgaacattattcttgataagtctgtagagctgttgttcgtcttcatttgtaaaacagtgatttttatcaactattacacacgcaactactattgcgtttaccctattaccaccgatctgcagataaatgttgtcaacaatatggaagagaactggcattacacaaattcctttcttatcaataagcattttatcgatattgtgtctaaaaactgtgttcggattgtgtgtaagatcaattacttggataaaaaggaggatatcgagaagctcctgcactccatcgctgccaccctgggcggagtctacatcgaggattacaatcccttgaagaatgagtttagcttttacatatggaagagaatcctgaataaaaagatcaaggatctgaaaagcgaggagctggaaaaacggatggaagatctgggcattaaagacataaaaaataagacccttctcgattacgttactaaaaagtacgagaatgaaatcaactttaagatcattaacgaggaaaaagtcaattggaacgagcttaactatgagatcaaggagaagattgtgcttggagccataaaggcacacccagcgatccgcaaactcattgagtacaaagaggaagaactgttggaggacattgggcagaagatcctcacttatttcaccatcaccgtcgaatccgacgaaaatgagaattatttcctggtggtcatgcccaaacatcggatcattagctccgagactatctatgaaatgctgaagtcaaacaaaattgacattaataagctgaagcgggacctgctcgggggcagcgtcttcataacaacatcccggaagggcgttcggcggaaaaaggtgaagattaaaaagattatcagccccaaggagcgcgagtatcggaagtacgttgaaatcattaataactactacaaggagaagggtattcctatcaaggtcgggggtgaagacatccactgttatattctcatcggagaagagaagattgatgtttaccacactaagaatgcactgctgtacaaaggtatcgacgaaaaaacccagaaaattatactggataaaggcaagtttctgcacgagctcgaaaccgcaaagcagattctgagcaaatacggcaatctgattgacttcgacggtgagttctctaatatcctcactaaggacggctacgtgatgacacagctgtctaccgtgcccaaaataaatatcaagctgagaactaaaaatggcatcaaaacctacaattatctgaaactgatgtatctctttgattggattttcaataaaaccctgaacgaccgggaaattttcctcccgcttgtgattcccccaatgttgaaagaaaaggagaaaataggcatttatatcttttattccaacatctccgatgtggagctgaacttcattaaagacattttccggaagctctcaatcctgcacaaactggataaaaacataccaaagattgaaattaaactcgaaaaggaaattgatttcgaggattacgctaactctcgggcgattattacccaaactgtgctgaataattctgaggagaaagaacagcccttcctcatctgtatctctccaaagctgccaaacaacgagtttgacgagctgaaatcacacctgttctcataccaacaaactactttccatcaattcatgtatcctttcaatctgaaaagatgcttgaacgacgacgactttaaaaaacccttcattaattcaatcctttctcagttctttcacaagatgggcatgtacctgtttagtttctccgaagagctgggagactacgacttcatcattgggtacgacatcacgaaggaaaaagacgaaaatgataagatcaagggtatcgggggatcagctatcatctacaacagccatggccacgtaatcaccaccgtgaccttcgaggacgtacacacctccagcgagatagctaggtatgagaagctctttgcaaaggtgtatagcgaactggttccccacctgaacttgaataataagaggaagataaaaatacttctgttgaaagacggcagaatctttaagaaggagttggagaaattgtctcttatcagcaagaagtatgggtttgagataatttacatcgacgtgcgcaaaagcactaagctgcgctttttcgacatcaaatctaaaaaagctgtacccgaaggtaagaacgcatataccaaattcggtcgagcctattatgtgagtagtcactactataaaaggttcctgaagcagcccatcaagattgtcgagaagtacaggatcgatgacggttcttacaagggagtgaaaatagaggaaaaggatataaagcagctgattcttctcacaaaaatcaattttagtcagctgatgcccgataaaatgaagctgccagccccagtccactacgctcataaacatgtcaatgcggtgcgaagaggctggaaggtggatgataagactatcctccggaatggatgtctgcctactatctagtaa

SEQ ID NO: 65 - DNA, 2271 bp, Artificial Sequence
  Description of Artificial Sequence: Synthetic polynucleotide
atgcccaaaaagaaacggaaggtggaagatcccaaaaagaaacgcaaagtcggaagcgggtccatggacttgaatgagttcatggagatcatccacccaatgctgccttccggcgggctggatgaaaaccagatgaacgtggtgatacatggccagggaccattgtgggtgattgccgggcctggaagcggcaagaccgaaaccctggtgatccggactctgaaactgatattcgtggacaacgtgaatccaaagagtattgttattacaacgtttacagagaaggcggccaagaatataaaggacagaatcagcaactacgcctacctgatctatcaaaagtacccagaactgcagcggaacctggacgttaatgatatctacataggtactttgcactccctgtgcaaccagatcatgctggagtacagatacccagggtatgagaattataggctcatggatgatattgaacaatacctgttcgtccatgagcacagcgacgctgtaaagcatcatcacaaataccaggatatgtggaatcactttaaatacttggaaaacaaatggaaccgcagtttcaactccagatgggggagaacccaggtggccacaaccctctttaaccggatcgtggagtacctcatagacatagaggaacttaagcagagcgatgagaagtgggctgtgcagctcgcagacgcttatgagaactacgtccagctgctggaaatccaccataggtgcgacttttcccatctccagaagaaatttctggaattcctgaacacgaaactgggcgagttgttcattaaaggggatggttctctgagacaccctgggatttcccacgtactggtcgacgagtatcaagatacgaaccccatccaggaagccatttacttcaaaatggccgagaatacccataacctgtgtgtagtaggagatgacgaccaggcgctctatcgattcagaggcggaactgtggaatgtatggtaaatttcgggaatgcttgtcaccgcgaatggggcattaccctcgaacgggtgaatacggtctttctgaacaataactatcggtcccatagggaaatagttaattactgtaacaagtttataacttctttccctgtgatgcagaagatcggagccagagtgaaggataaacctgaacttaaccccaagtccgatatttctggcaattaccccgcagttgcctacattacagggcggaccattgaggagacagcaaataattttgccaatttcgtcaggtacctcctggacgaaggcgtggtgtccaagccatccgactgtgcgctccttatgaaatctgtgcgcgaaaatcgcaattgggcggagcccttcaagaaggctctgaacaaggtcgggatcgaagtatacaaccctagatccaggaaatttctcgagcaggaggaagtgatggccgcacttggagcttttatcaccattattgaccccaagcagaatgcgctcaggaaggtttgcaacgaaaacatacagagactggtgaatcgctgggtggacacatacaggaatgtggcatccgagagcccggaactgcgaaagtacgtggactgttctatcaagagcatcgccaaacgaaatctgggtgaaaggctgaatattaatattagcgagatcttgtacaggatactcgcccacccccccttttccgattggctggacgacccggagcgaagctataggcttgggaaactcacccagctgttcgagaagtattcttccatcccctacgataccccagggtctacacgaggactccttaaaatgtcatctaagaataacggagaaattagtttccgctggagacaaaatttttataattcttttattggactgctcagtactgaagggctgaacgatcctgaggatgaggaaattatctgtcctccagatcgcctgccgattatgaccatccatcaagccaaaggtttggagttcccctttgtcttcgtgtatggcttgcggttgaagggagacaagccaaatgagtccgcaattatagaggaagacttgtacaagtataggaaaatcaagtatagtatcaactttaccccactggaaagaacgcagcaagacctgatccgactgtactatgttgcctattcaagggctaagtatgctctgattcaccttgtaccaagaaatcatatggggtcaaagggcttcgggtttattggaaataactttagcctcttctctgctatcgtgaaaaaaatctagtaa

SEQ ID NO: 66 - DNA, 2157 bp, Artificial Sequence
  Description of Artificial Sequence: Synthetic polynucleotide
atgcccaaaaagaagcgcaaagtggaagatcctaagaaaaaaagaaaagttggctccggatctatgccagtgtatcttaaccggttccttttggaccacctgacctcacctctgtcattgcctgcctttcgagttgaacttgatccccctccatcaaaggacgaagtccaccccctgctggcgctggttggacgcgaagccggtgggttggtgcggtttcagaacaggctcatcggctgggaagcaccgcgggcactcgagggacaggtgcggcggggtaagcagtcttacagacttgtgcccctgggaagacaagcactgaacctgcgcaagccagaggaacgacaggctctggagaatctctatcggattagactcgagaatatcctgaaagctttggccaagcgccaccgggccagggtggagcgccggggcaatggactgttcctttggcggcccgaaaatccccgagaagaaaaagaggggtggcacttgtacagaggatccctgtatcgcatccatctttacccagatggcgaagtgatcctcgaggtggatgtccaacaccgcttccagcccaccttgcacttggaggagtggcttcagcggggttaccctttgccacgccgagttacaaacgcatatgaagatgagaaagagtgggctcttctggggatcgaggaagggaaggacccacgcagttttctccttgatggtggggagtccctgttggattaccaccgaaaaaagggccggctggccgaaggacaggatccaggcagagttgtatgggtcgcccgaggaaaggaacgagaacgcatcccacacctgtctgtcctgttgaagccagtgattactatggaactgctggcggaggtggctgaagtgacccaggaagctctccctgccctgcagctggagccggaggaacgactcaaagacatcaggcgattcgctgagcccgtcttgcaggctttcggaaagcgcgagactgctaagccgcttgagggtcgggcccaaaggcttccaagaccatcccttctcgcacggggaaaaaagcgagtcggcaaggtagcggacgtgctggaaaagggagcattgagcccaggggaaacccgactcgcccttcttgcatgggaaggcgacgggaaggctaaagggggactcgcctatctcgaggagcgcctgcagggcgtgggctcagccagcggaatcaaactggagttgaaaagaagatttctccctagaggggacaacctggagatggcccaagtctttgaggaactgtcccaagagggtgtcggagccgggctgttgctcactcccaggctcaccgaaggcgaaagacgagagctgaagaatacggccgcctcacacggtctggcacttcagctccttaatccatttgaccctggagatatctacagagttaacaacgctctgctcggctttcttgcaaaggcgggctggctgttcctcaggctggaggggacataccctgcagatctggtggtggcctacgatgcagggggggagtccctgaggtttggcggggcgtgttttgcacacctgacagacggtacacatctgggttttagcctcccggccgcccaaggaggcgaacggatggctgaggaagtcgcttgggaactccttcgccctctgttgctgagatacaggaaggcgaagggacagactcctggccggatcttcctgctgcgggacggcaaaatccagaaagaagagtttcgaaaggttgaggaagagttgcgaaaaaggaatattccatatgcactcttctctgttaggaagacaggagctccacggctcttcagcaagaatggaccccttggggacggccttttcctgaggcttccagaggaggagggtggattcctgctcctgagcgccgaaggcgggaagggcacgcctaggcctgtgaaatacgtcctggaagctggagaagtagaccttaatctggaggaagcagctaggcagttgtatcacctgtcccgcatatacccgggctcaggatatcggtttcccagactgcccgcgcccctccatatggttgataggatggtgagggaagtggcgagactgggcgggtcccacaacctgcggctgaaagaggaacagctcttctttctgtagtaa

SEQ ID NO: 67 - DNA, 2952 bp, Artificial Sequence
  Description of Artificial Sequence: Synthetic polynucleotide
atgccaaagaagaaaaggaaagtggaagacccgaagaagaagcgcaaggtcggctctgggagcatgcatcctgagggagcagacctgatccaaagaaaccgggcagtgcaccgaatgcttgtggatggcgtgactgtggagtataggacctccgagggggcaatccggggggcccaggcgcgggtcatagacttcgatgatccagaaaataatgattggttggcagttaaccagtttactgtggtggagaatcgccatcggcgccgcccagatgtcgtccttttcgtcaatgggctgccactcgcagtgattgaatttaagaacccaaccgataaaaaggcaacaatatggagtgcatacaggcaattgcaaacatacaaagccgagatcccctccctgctcgtgtataatgaggccctggtgatttccgatggattggaggcaaggatcggcacgctgaccgcagacagagaccgattcatgccctggaggacaatcacaggcgaagatgtggccccagccgagatgccccaactcgaggtcctgttgaagggagtgttcgaacggcgaagatttctggagctggtgcgcggctttgtcgtttttgaagacgaaggggggggtaaactggccaaaaagatggccgggtaccaccagttccatgctgtgagagtggccgtcgaagagacactgcgggcagccgccagatatgaggcaggacgccaacctgggggaaaacccggcgaccgaagaataggggtcgtctggcatacccagggctccggcaaaagcttgaccatggtgttttacgccggccgcataattaggcatccccgaatggaaaacccaactatcgtggtactcacagatcgcaatgatttggacggacagttgtttggtgtcttctctcggtgccgcgaacttctcgggcaagatcctatccaggccgaaagccgcgcccacctgcgggagttgcttcaggggcggcaaagtggaggagtgattttcaccacaattcaaaaattcctcccagaggagaagggggatcgatacccacagctgtctgataggcgcaatatcgttgttatcgccgacgaggcacacaggagtcagtatgatttcattgacggtttcgctagacatatgagggatgccctgccgaatgctagcttcataggcttcacaggcacacctctcgagctggatgatagaaacacccgctcagtgttcggagattacattagcatatacgacatacaaagagcagtgcttgacggcgctaccgtgccaatctactatgagtcaagactcgccaaactggaccttcctgaggaactgaagccaaaagtggatgaggaatttgaggaagtgaccgaatccgaggaagtcgagcgaaaagagcgcctgaagacaaagtgggcccagctggaagcggtagtaggggcggaaaaacggctgagactggtggcccaggacattgtgactcatttcgagcaacgcctggaagctctggacggaaaagccatgattgtatgtatgtcccggaggatttgtgttgagctctataacgaaattgttagactgcgcccagcctggcataacgatggggatgataaaggcgtgatcaaagtggtgatgaccggaagcgcctcagatccagttgaatggcagtcccatattcggaacaaacagagacgggaattcctggccaaaaagcgctttcgcgaccctgctgacccctttaagctggtcattgtgcgcgacatgtggctcaccgggttcgattgcccttcccttcacactatgtacctggacaaaccgatgagggctcacggcctcatgcaggccattgccagagtcaaccgggtgtttagggacaaacctggtggcctggtggtcgattatctgggactcgctcacgaactgaaagccgcactggccacctatacggagtctggcggaacagggcgaacagccatagatcaatctgaagctgtcgccgtgatggaagagaaatacgaaatctgccgaaacctgtttcacggctttgactggtccctgtggaaaactggcagacccgaagaaagactcgccctgcttccagccgcccaggagcatattctcgcgcaggagaacgggaaagagcgcctcctgcaggccgtgagtgagctgtctagagcgtttgcccttgctctgcctcacgaaaaggcactggccatccgggacgacgtcgcattttttcaggccgttagggccgccctcgcaaaacgcgccagctctgaagagaggaccgaagaagacttggatcacgccatcagacagattgtttctagagctctgatgcccgagggggtagtagatttgttcgctgccgccggcctcaagaagccggacatcagcattctgtccgaggaatttctggccgaggtcagaggaatgcctcagcggaatctggctgtggagctgctccgaaaactgctggagggcgagataaagacgcggcgcaagaagaacgtcgtccaagcgcgctcttttgccgaaatgctggagcaagccattagaagatatcagaatcgggccgttgaagcggctcaggtgatcgaggaattgatcgcgctcgcacgggaaatgcgggaggcagacaggcgaggacaggctctgggccttagtgaagaagagttggccttttacgatgcattggagaccaacgacagtgctgtgaaggttctcggcgagccaactcttcgcgagattgcaagggaactcgtggatactgtcagaagaaacgtgacaatcgactggaccgagcgagaaaatgtgagagcccatctgaggcgcttggtgaagagggtcttgcgcaagtatggatacccacccgataagcaggagagggcaacccagactgtgctcgagcaggcagaggtactctcagagcagtgggccgcctagtaa

SEQ ID NO: 68 - DNA, 3075 bp, Artificial Sequence
  Description of Artificial Sequence: Synthetic polynucleotide
atgccaaagaaaaagaggaaagtcgaggatccgaagaagaaacggaaggtgggttccggttctatgccttcagctcaacggtgcatctgggagtggaagagggatatcttcgtgaccaagaatccgacgctccgggagtccgtggatgaacttagcttgccagggaccaggcgcatcgtacagggatggatcgaccagcaagcccaatacccggaagatgggtcagcagacgaatatagcttttatgccgaagagtgctacccaacctctcatgaccggcgagcgttcttccatcgcttcattgccgaggcgagaccgcatatcggctacaagctggttgcgcagttggcagaagcagggttcttgagaaccatttggacgaccaactttgacggactggttagcagagcgtgcacagcggctaacgtcgtgtgcgtggaagtgggcatggacacaccccacagggcctcacgaccgcaaggggatgacgaagtcagactggtgtccctccacggtgactttaggtatgacctgctgaagaacaccgccaatgagctgcgcgagcaggatttggcccttagggaggaactgctgcacgaactcaaagactacgacctggtggtcatcggatattcagggcgggacgacagccttatgcaagtgctctctgctgcctacagcgaccgcgcatcttgtaggctctactggtgcgggtttggcgcggaaccagcaccggaagtgaggcaccttattaagagcatcgacccagcccgagagagcgcgttctacgtggataccgccggatttgacgacgtaatgagcaggcttgcactcaggcgactgagcggtgaaagcctcgaaagggcccagaagctcatagaaagcgtcaccccggttgctggcaaaaagatggcctttagtgttccaccattggcccctagcgccttggtgaagggtaatgcctaccgattgacctgtccggcaaacgtcttgaaacttgatatcgaacttcccgagcacggttcctggcgcgattggctgtccgaacgaatgactccagaaagggggcaggccgttgtgttcgagaagggagcactggttttggccgacatggcggttaccgctaaagttttcgatggatttcttagggtgagcccgacacgggtggagataagtgacgagaacatcatcgctgacggccggatcgccagtctttaccgacgagctctcgtgagcagtgccgcaaaagcgctccagatccaaaccgaccacaggaggaggatatgggagcccgtgcactatgatacaaggcaactcgacgatgtgacgtaccgcgtgcatcgagccgtctccctgacgatagtagggatagagggagtgccccatgtggtgctgatgccagaggtcgtcgcatctacgttggcgggcgaccttgcgccggttgacagtcaaaagactctccgcaatgccatttacgggttccaacataacgataagtttgatgccgacctcagctattggacccaccgccttgttgagaaggagctggcttccagcggcgagggcgttttcgtattgagcaaagtgccactttatgcgggcctggcacaaaaaggtaaagctcctctcccacacaggtttgcacgccacgctaaacagcatggaattattgtgcccgacgcaccgcttgttttcagcgccaaggttggctctggagaggtacgaaaccccaatccgctgcatgggctggtgcaaaaccggccatgggaccactctcttacggcgtctggtttgtgtccgagtacagatgctagcgtgatctgccccgcagacgctgctccgaggtttgagagattcctccaatctatgcaggaggtagcaagaccaagccagagcgagagggactatttgcatgattttcccggcttccctgcggcctttggactgccactccgaatgcccgtgagaggggacgcaaactggattaccatcgacgacggagtgagcaccgatgccctgacaggggctaagcaactggcgcaccgagtgtgccaagcactcgaccacctccgcagagcaaggccctctgacacggcgatcgtgttcgttcccaggagatgggaaccatataaggtagtggacacgcagcacgaaagattcaatttccacgattacattaaggcctacgcggccaggcacagtcagagcacgcagttcgtcagagaagagaccatccaaagccaatacgtgtgtagggtccggtggtggttgagtttggcactgtatgttaaggctatgcggaccccctggcggctggatgcgcttgatgagaatacggcttttgttggtatagggtactccctggacgcagaggcagggaggggcaaccatgtactgctcggctgcagccacctgtattctgcgaggggtgagggattgcagtttaggctgggccgaatcgagaatcccgtggtgcgaggaaggaaccccttcatgagcgaggacgacgcaaggaggaccggagacaccatccggcagcttttctacgatagcaaaatgcatattccgacaagggtggtgatacacaagaggacaaggttcactgacgaggagcagagggggttggtacaaggattggacggtgtgaggaatatcgagctgatagagatcaaccaggaagagagcttgcgatatctcagcagccagatgaaggacggcagatttgagatcgacaagttccccctgttcaggggtaccacaatagttgagtcagatgacactgcattgctgtgggtgcatggagccacacccagcgccgtgaacaagtactggaggtactaccaggggaagcgccgcattccggcgccattgaggattcgaaggttcctcgggcaaagcgacgtagtgcagatcgcgaccgagatcttgggactgtctaaaatgaactggaatacgcttgactactattcaaggatgcctgcgactctggattctgcaggcagtattgccaagttcgggtcatatcttgatgggtttacgagcgcaccctatgattacagacttctgatctagtaa

SEQ ID NO: 69 - DNA, 2310 bp, Artificial Sequence
  Description of Artificial Sequence: Synthetic polynucleotide
atgcctaaaaagaaaaggaaggtagaggaccccaagaaaaagcgcaaagtagggagcggtagcatgaactataccgctgctaacacagcgaacttcccgatatttctgagcgaaataagctttctcacaaccaataacatttgcttgaactgtttcaagcttaactaccaggtaacgaggaagatcggtaaccgattttcatggcagttcagcaggaaattccccgacgttgtagtgatattcgaagacaactgcttctgggtcctggcaaaggacgagaagttcttcccctcaccacaacagtggaaggaagcacttagcgatatccaggaggttcttagagaggacatcggggaccactactacagcatctattggcttaaagactttcaaataaaggccctggtgaccgcccaactggcggtgaggatactcaagattttcggcaaatttagctacccaatcgtctttcccaaggatagccagatatcagaaaatcaagtgcaggtcaggcgcgaagttgacttttgggccgagatcatcaatgacaccaaccccgcaatctgtctgaccgtggatagtagcattgtgtacagtggcgaccttgaacagttttacgaaaaccacccctacaggcaagacgccgctaagctgctggtgggactgaaggtgaagaccatcgaaaccaatggcaccgcgaagatcatacggatcgccggtaccataggcgagcgcagagaagacttgctgaagaaggccacaggctcaatgtcacgacggaaactggaggaagcccatctcgaacaacccgtcgtcgcagtccagttcggaaagaacccccaggagtacatatacccgcttgcggcccttaaacctagcgtgaccgacgaagatgagagcctcttccaggtcaaccacggagacttgttgaaggagaccaagatcctgtatgcggagaggcaggagcttctgaagctgtacaagcaggaggcccagaaaaccctgaacaactttgggttccagttgagggagaggtccatcaattctcaggaatatcctgaggtgttttggactcccagcatcagcctggagcaaaccccaatcttgtttggcaagggggagcgaggtgaaaaaagagagattttgaagggcctgagcaaaggcggagtgtacaaaaggcacagggaatacgtggacacagctcgcaaaattcgcctggccatacttaagcccgctaacctccgcgtgggcgactttcgggagcaacttgagaagcgattgaagctttataagtttgagacaattctgccaccggagaaccaaattaacttcagtgtcgaaggcgaaggttccgaaaagagggcccgattggaagaagcggtcgacagactcataaggggggagatccccgtagacattgcactggtgttcctcccgcagagcgataggaatgcagacaacaccgaggagggaagcctttacagttggatcaagagaaaattcctcgataggggcgtgattacacagatgatttatgagaaaacgcttaacaataagtcacagtacaacaacatcctgaaccaggtggtgccggggattcttgcgaagctgggaaacctgccatacgttcttgcagagccgcttgagatagccgactacttcataggcctggatgtggggcggatgccaaagaagaatcttccggggagcctcaacgtgtgcgcgtctgtcaggctctatggcaagcaaggcgagttcgtgcgctgccgcgtcgaggacagcttgaccgagggcgaagagattccccagcggatcctggaaaattgcctgccccaagcagaacttaaaaaccaaactgtccttatctacagagatggtaaattccagggaaaggaggtggataaccttttggctagggctcgcgcaatcaatgccaagttcatactggttgagtgctacaagaccggtatcccccgactgtataacttcgagcaaaaacagatcaacgcaccctccaaggggctggcactcgcgttgagcaaccgagaggtgatcttgattacgagccaagtgagcgagaagataggcgttcctcggccacttagactcaaagtgaatgagctgggtgaacaggtgaacctgaagcagctggtcgataccactcttaaactcacgctgctccactatgggtctctgaaagacccacggctgcctattcccctgtacggtgccgacatcatagcctatcggcggctgcaaggaatctacccatcccttctcgaggatgattgtcagttctggctgtagtaa

SEQ ID NO: 70 - DNA, 2184 bp, Artificial Sequence
  Description of Artificial Sequence: Synthetic polynucleotide
atgccgaagaaaaagcgcaaggtagaagaccctaaaaagaagcggaaagttggcagcgggtcaatgaacacgcctttgacgcattacgtgctcaccgagtgggaatccgatacaaatactaatgtattgcacatccacctgtacaccctccccgttaggaacgtgttcgagcagcacaaggagaacggtaacgcatgtttcgatcttcgcaagctgaataggagtctgatcatcgacttctacgaccaatatatcgtgagctggcagcctatagaaaactggggcgagtacaccttcacccagcacgaataccgcagtataaacccaacaatactggccgagagggccatcctcgaacgactcctcttgcggacaatcgaaagcgtccagcccaagaaggagatcgcagctggttcccgcaagtttacctggctgaaggcagagaaggtcgtggagaacattagcatccacagggtaatccagtgcgacgtaaccgtggactacgccggcaagatctctgtgggctttgacctcaatcacagctataggacaaatgagagcgtgtacgacctcatgaagtctaacgccatctttaagggagaccgcgtgatagacatttacaataacctgcactacgagtttgtagagatttccaactccacaataaatgactccatccccgagctcaaccaaagtgtcgtcaactactttacgaaggagcgaaagcaagcatggaaagtggataagctggaacagagcatgccagtcgtgtacctcaaggcattcaacggcagtaggattgcatacgcgcctgcgatgctccaaaaagagctgacctttgagagtctcccgaccaacgtagtacggcagacgtcagaaatattcaagcaaaatgccaatcagaaaatcaagaccttgctggatgaaatccaaaagattcttgcccgcaccgacaagatcaaattcaacaagcagaagctgttggttcagcaggccggctacgagatacttgaactgtccaacccaaacctccagtttgggaagaacgttactcagacgcaactgaagtatggactggataaaggcggagttgtggcctccaagccgctcagcatcaatcttctggtctacccggaacttatagacaccaagctcgatgtgatcaacgatttcaatgacaaactgaacgctttgtcccacaaatggggcgtgcccctgagtatcctgaagaagtctggagcgtaccgcaacagacccattgatttcactaacccccaccagctcgcgattctgttgaaggaactgaccaagaaccttttccaggaactcacgcttgtgataataccggaaaagatcagcggcatgtggtacgatctggttaaaaaggaatttggcggcaatagcagtgttccgacgcaatttatcaccatcgagacacttcagaaggcaaacgactatattctggggaacctgctccttggcctctatagcaagtccggcatccaaccatggattcttaatagcccccttagctccgactgcttcatcggtctggacgtatcacatgaggcgggtcgccacagcaccgggatagtccaagtcgtaggaaaggacgggcgcgtgttgtcatccaaggcgaatacgagcaatgaagccggcgagaagatccgccacgagaccatgtgccaaatagtgtatagcgccatcgaccagtaccagcaacactacaacgagaggcctaagcacgtgaccttccaccgcgacggtttttgcagggaggacctgctgtcactcgacgaggtgatgaactccctggatgtccagtacgacatggtggagatcatcaaaaaaaccaatcggcgaatggcactgaccgtcggcaaacaaggatgggaaaccaagccaggactgtgctacctgaaggacgagagcgcctatctgatcgccaccaatccgcacccgagggtgggcaccgcgcaacccatcaagattatcaagaagaaggggagcctccctatcgaggccattatacaggacatctaccacctgagcttcatgcatatcggctcactgcttaagtgccgactccccatcacaacttattacgccgatctgtctagcaccttctttaaccgccaatggcttccgatcgatagtggcgaggcccttcacttcgtgtagtaa

SEQ ID NO: 71 - DNA, 3081 bp, Artificial Sequence
  Description of Artificial Sequence: Synthetic polynucleotide
atgccgaaaaagaagcggaaagttgaggaccccaagaaaaagcgcaaggtgggcagcggctccatgcttatctggcaattcaagagaatgctctactgccaggccaacaacatcaaagaggaaaaattcaaagacctggagagcgagcgaaatcaaaacactatccagagctattttgacctgaagggcggctatccggaaagatatagccaggaggaatactccgcttatttcgagcattgcttcccgaagtctatcaaccggaagtatttcatgcagaaaatagtagagggccgaaatccgagcataggtcacaagtgtttgggtgccctgttcgactgcaaaaaggtaaaccacatctggacaaccaacttcgacgagctcatcgagaatgggattaaaagcgtcaacaatgccagcagcttcgaggtcattagtatcgacaatcagaggcagctggccaacctcaacaactacccaagggtggtaaaacttcacggcgactacaggtacgacaagctccaaaataccgttgacgaactgcagacgctggagaaggacctccataagtacttcgccgatgtgcaaagcaagaccggcttgattgtgataggctacggcggaaacgaccagagcatcatgtccgcctttgaaaagactttggaggccgacaacccgttcccgtttgggctttactggtgcgtgaggacgggccagaaaaccaacaagaaggtaatcgaattcatagagaaggttcaccagaagaacaaggaaaagcttgctgcgttcatcgaaatcgactcttttgacgattttctttatgagctgtataagacgaacaaccttgccaacgatcacattgaaaatatcgccaaaagccgcttcgaaaaaaggaaggcttttacagccccccagatcggcacctcctttacgcctataaagcttaacgccataaaggccaagacttacccgaaaagcatctattcctttaaaactgacctcaaggggggcaaggatgactgggataaactcagggaaatcattaaggaccaaccggtgagcgcggctctgaccaatgaaaacacggtcgccttcgcaagtgtcaacgacatcaagaaactcttctcacacacactgaagtcagagatcaccaccgtggacatagatgacaagttgatctatcggcaggagtctttctacctgggcatgctttacgatctgatagagcacaacctcctgaagaagttcaagttggagaaagtgcccaacaataggctccgcaagtattatagcaaaaactacaagctgaataccgaggagcttcagaagtccaagatcaagaccagcctgtccgtctacgaagcgttcgagattcaaatagaattccacaataaagagctgttcctcattatccttccgtccatccacatagacgacaaagccgggctgagccgatttgagaaacaggagatagccaataagatcataagcaaaaggtggaaccgcatggttaacaaccagcttaggttctggctggggctccttaagaacgataacactaacatagagttcagcatcgacagtttcaagattgatttggaagaaaagttctccggcgtcgggagctttacatcctcttactacatctttaagggcgcgtttatttccaacgaacccaagcttagcttccatatctccgacagcaattacaaaacagtgcaccccctgaaaggcctcaagaacttcggtccactggattactcatttgaaagcaaacagaccaatcagcaggctattaaacttggtataatcactccgatcagcggcatgcaacggatactcaaacacctgaacgaacttaataacgagatccgcgcagctacggaaaaggagtacctgaccgattattacccctttagcaacatctacaagagataccttgacatcccgcagaataaggatagtaaattcttggaactcgtgaatgaagccgaagtgaacaaactgaaccacctcgagttttatgacttcctcaaacgcaaaattgattacttctatacaattaggggcgagttcgacgtgcttgtgttgtattttcccaaaggctggactaagttccgcgagctgaaaaatgacagtgtctactttgatctgcacgactccatcaagctgtactgtgctaagaagaatatcaagatccaattcgtggaagataagagtatagactacctcgacccggccaaggttaaatggtggttgagcctcggcttgtatgtcaaagcgaacgggctgccctggcggaacgtggtcgtaaacgaaagcaccgcgtttgtcgggctcgacttcgcggtccagcgaataaacaacagtaacaagtacgtgctgggtagctcacagatcttcgacagctccggacaaggactcaggtttctgttgcagcccatcgaacaccctgtgtttatcggtaaaaaccccttcatgagcaaggaagatgcgcgacggatgattcttaaattgaaggaagcgtattttaggattgacggtaactccaagctggaaaaactggtggtgcacaaagtactgcattacacaaatgatgagatgaccggcatttccgaggcgctggaaggtattgagaacattgagcttctgcaaatacagaagtatagtaagtggagggcaattagaggggacatcgatcggtatacgggaaaggtgaagaccgacccgcacaatttcccgatccaacgggggacagtgatccagctcgacgacttctctttccttctgtggacacatggaagtgtacaggaagacgacgtggctggtaggcacatgaattactaccagggtaagcgcgggattcccgcaccacttctcatacggaggtttcgcggcaccgatccgattgaaatgaccgtgcgagacatcctgtcactcaccaagatgaactggaacggaggcgaactttacaagactctgccggtgaccctggatttctctaaacggctttctaagtatgcgaagcaggcagagaccctccaggcaataccctacgactttcggttcttcatgtagtaa

SEQ ID NO: 72 - DNA, 2091 bp, Artificial Sequence
  Description of Artificial Sequence: Synthetic polynucleotide
atgcccaagaaaaagcgaaaggtagaggaccccaaaaagaaacgcaaagtgggctccggaagcctgaagctgaaccacttcccccttaatcccgacctccccctgtacatcacagaatatgcccaccggaacccgcgagcgttgctcggattcgttaggggccaaggtttctgggcgcaacaggtcggagaacaggtacaagtgtaccacggtagaccgcagcccacgttcaggggagttcaggtgatcagccataccaggttggaccccgaccatccggcttttgaccaaggcgttttgagcctcatccgacaagcactggtgagggcgggatacgtgctgacctacagggagaggatggctattcatcccagactggagagggttgtgctgagacccccggaccggcacccagcagagttgaccgtccatgcacatctgcgatgggaatgggagcttgaaaggcacagcggacaacgctggctggttcttcgacccggcaggcgacatctgagcgcccttccatggcccgcagaagcagtacaaatgtggtccgccgctcttccggccacctgccagaagctgcacgccctttgtctggaccgaggccaacagatggcccttttgcggcaagaggacggctggcacttcgccaatcccggtgctgccactcaaggaaggtggcacctgtcctttagcccccaggcccttcacgagctgggactggcacaggctgcgcaccatgcggctgcatttaggtgggacgaggtacagcgactcgtgcaactgactgacctgtggaagcccttcgtgacctctctggagccccttgaggtagctgcccccatcattgccgggaaaaggctgaggtttggacggggtcttggccgcgatgtcacggaggtgcacaagcgaggtatcctggaaccacccccactgcccgtgcgactggctgtcgtgtctccccatcttcctgatgagcacgcgaacgcccagttgaggcgggagttgcttgctcacctcctcccgcgacaccaagtactgagatcagcggagagccggcaaggcctccacgagcacctgaggaggcaagatcaggacgataccctgtataccttttggtcaggcggcgagtacaggaagctgggcttgccccccttcgatctcgcacgaggcctgcacacctacgacccagctagcggccagctgcaacaaccggctgccctggcaccagcacccgcgcaggccacgcaagcgggtaggcagctgatagccctggtggtgttgcccgacgacctgacgcggtctgtccgggacaccctgtttcagcagctccagcagttgggccttaggtgtctgtttagtgtgagcaggaccctgctgcaccgaccacgcacagagtatatggcatgggtaaacatggccgtcaagttggctaggactgcaggggccgtgccttgggacctggcagacctgcccggtgtcaccgagcagacgtttttcgtaggcgttgatctggggcatgaccacacccaccaacagtccctcccggccttcaccctgcacgaccataggggacgccctcttcaaagctggacgcctccccgacgcaccaataatgagaggctgtcattggccgagcttaagaaggggttgcataggcttcttgcacgcaggagcgtggaccaagtgatcgtgcatcgagacggccgattccttgctggcgaggtggacgacttcactctggcgttgcatgatctcggcatcccgcagtttagcttgttggcaatcaaaaaaagcaaccacagcgtggcggtgcaagcagaggaaggatccgtgcttagcctggacgaacgacgatgccttcttgttactaatacccaagccgcgcttccgcggcccacggagttggaactggtccatagcgacaggcttagtttggcgaccctgaccgaacaagtattctggctgacccgcgtcttcatgaacaacgcgcagcatgcgggcagcgatccagccaccatcgaatgggccaacggcatagccaggactggacagcgagtgcccctggccgggtggcggctgtagtaa

SEQ ID NO: 73 - DNA, 2280 bp, Artificial Sequence
  Description of Artificial Sequence: Synthetic polynucleotide
atgccaaagaagaagcgaaaagtggaggaccctaagaaaaaaagaaaggtgggctcagggagcatggaggcgtacataacggagatggtgtccagggagagggccaacgagctggaggtttacgtgtacgtgtttccacggaagcaatccgacaacaactacgagggtgtgtatcacataatgagggcgtggcaacgggctaatgacctgcctctggcgtataatcaacatacgatcatggcattttcccccgtgaggcatatgtgtggctacacgccgatggagacgcagaaacgccatattaacattgactccccattcgagagagccctgctggagcgactgataaagaacagcctgatttttacagccgagcgccatttgcatgccaagcgggtaggccatgcgcttcggctgaaccaggtgcagcaaatccggcaggtgatcatctatgaggccatcgagctctatgtaaatatcattgagaatagaataagcatcggctttcacctcacccaccagttcgagtacgtatacactctccagagcatgatagaacagggaaaaacaatcagacctggaatgcgcgtcgtgcattctaacggaaggcagcattatacctacaccgtggagaacgtagcaacatatggggtgaccgacagatgcccgctgctgcagaccagcatttaccaatactacgtcgaaaaaggcgcgcagcacattttgcgcaccttcacccgatccaccagggtgatccacgtaagaacgaaagagcagaggttgagctacgcggcgacactcctgaaaccgctgtgtacttttgagaccatgcaaccccaggacgtgctcaatgtcagcaagtgcatcaaacttagcgcgagcaaacgaatgaaatgtacttacaggtggattcagcaactccgggcacagtaccgacacctgacctttgcgccgaaccccttcacgatcgcccagaatggctataaacttgatcagctcagcacccccaaggtgcacttccacagagactacgccaccgtcgtgagcggaatgaagaccggcaagctttacaaaggcggtaatatcaagatcagcgtgctcttcgacgaggacttttacttgaaacaccacatcaccaagaaggacatatatcaattcattgcagtcctgcagaaaatcgccatcgcacaaggcgtgaacatgaccataagcacgagcaccaagtccattacgggcaagttcacggacgactttttccaccacttcaccgaggaggtcgaagcactgcagcccatcttcgcgcaaaccacagttctggcattcattaccagtacccacctgagcaacaagaaaaccaggagttaccagctgctgaaacagtacttcggcggcaagtgggacattgcctctcaagtcatcacggagaagacgattgaggcgttccaaaaaatcttgcacaagcacggcctgaagaatttctaccccaatgacgaacagcactgtctccgcgtgatcgatgtcctcaagaatgagagcttctactacacggtcatgaacatcctcttgggagtatatgtgaaaagcggcatccagccctggatccttgctaatacaacccactcagactgcttcatcggcatcgacgttagccacgagaacggaaactctgcggctgggatgatgaatgttatcggcagccagggccaccttatccaacaggcgcccctgaacggcatattggcgggagaaaagattgacgacaccctgctcgcaaacttgcttaaacaaatgattaaggcataccacacccagttccagcgctttcccaagcatataacaatccacagggacggcttttggagagaacacactgcactggtcgagaagatcatgagccactatgagattacctacgacatcgtcgagatcatcaaaaagcctaataggaggatggctttcttcaacagcgtggacaacacctttagcaccaggcaggggacagtgtaccaacggggcaacgaagcctttctgtgcgccactaaccctcagcagaaagtgggcatggcacaaccaatcaaaatacatcaggtgaccaagaccctgcccttctcacacatcatagaagatgtctacaacctcagcttccttcatattcacgctatgaataagatgcgactgccggccaccatacattatgccgacctgtctgccaccgcttaccagaggggccaagtgatgcccaggagcggtaaccagacaaatctgcctttcgtgtagtaa

SEQ ID NO: 74 - DNA, 2010 bp, Artificial Sequence
  Description of Artificial Sequence: Synthetic polynucleotide
atgcctaaaaagaaacgcaaggtagaggatcccaagaagaaaaggaaggtggggagcgggagcgttcacgcattgctcgctctgctcgcgaaccgagccggtggaaggaccgccagaatgggagacagcttgctcacgtggagccctcctgagtctctgctgcttgaagggaccctgagctggcgcggcaacacctacacataccggcttcgcccactggcgagaagggtgctcaaccctaggaatcccagtgagagagacgccttgtccgcgttggcgcgacgactcctccgagaagtgcttgagcaattcaggcgcgaggggttttgggttgaaggttgggccttttacaggaaggagcacgcacggggtcccgggtggcgcgtgctgaaaggtgcggcgctggatctgtgggtttcagccgagggggccatggtattggaggtggatccgacttatcgaatcctgtgtgacatgacactcgaggcgtggcttgcacagggacatccacccccgaaacgcgtcaagaacgcgtacaacgacaggacatgggaactcctgggtctgggtgaggaggacccgcaaggcattcttttgccaggcgggctgaacctcgtcgagtaccacgctagtaagggcagaatcagagacggcgggtggggtcgggttgcgtgggtggcaaatcctaaagacgccaaagagaagatcccgcatttgacgagcttgttgatccccgtcttgaccctggaagacctgcatgaagaggggggctctaacttggccctctccatcccgtggaatcaaaggcaagaggaaacccttaaagtggccctgtccgtggctcgccgactcggcgtcgaacaccccaagcccgtcgaggccaaagcctggaggatgaggatgccagagcttcgcgcacgacgcagggtgggtaagccagcggacgcccttagagtggggctgtaccgggctcaagagactaccctcgcactgcttcggctcgatggcggcagaggatggcctgactttctgcttaaagcattggagaacgcttttagggccagccaggctaggcttcatgttagggaaatccacgcggatcctagccagccccttgcatttagagaagccttggaagaagcgaaagaagcaggtgtgcaggctgtcctcgtactcacccccccactgagttgggaggagcgacaccgcttgaaagcactgttcctcaaagaaggactcccaagtcaacttctgaacgtccccatacagagggaggaaaggcatcggttggaaaacgccctgctcgggctcctggcgaaagcgggtctccaagtagtcgcccttgagggcgcataccctgctgatttgacagttggatttgatgccggaggccgcaagtcctttaggttcggaggtgccgcatgtgctgtcggctccgacggaggtcacttgctgtggagtctgccggaagcccaagcgggcgaacggataccaggcgaagtagtttgggacctgttggaggaggcgttgctggtgtttaagagaaaaagagggcggttgcccagccgggtgcttctgctgagggatggcaggcttcccaaggacgagttcaccctggcacttgcaaagctgaggcagctcggcattggcttcgacctcgtgtccgtaaggaagagtggaggcggaaggatttatccgacccggggaagattgcttgacggccttctggtgcccgttgaagagaggacttttttgctcctgacggtgcatagggagttcagaggcaccccacggcccctcaaattggtacacgaagaaggtgagacacctctggaggctctcgcagagcagatctaccacctgacgaggctgtatcctgcatcaggtttcgcatttcccagactgcccgcacccctgcacttggcagataggctcgtgaaagaggtgggccgattgggcgtgaggcatctcaaggaagtagacagggaaaagctgttctttgtatagtaa

SEQ ID NO: 75 - DNA, 2358 bp, Artificial Sequence
  Description of Artificial Sequence: Synthetic polynucleotide
atgcctaagaagaagcgaaaagtggaagacccaaaaaagaaaaggaaggtgggtagcggcagcatgaacgccgtgaccgtgggcagcaccccaagcgcccaggtactcgtcggtgttcagccatacgacgaaaccaccctggagagcctgagaagtaaacaccgcggagactatctctttaaaagggggggagagaacggcgatagcatacttgctgtggccctgaaaccgagtctgccggtcatcggagcaaccgaggaggatgtaattcttgccgagagcccatggttgttggctccacttgccttggagactttgctgcaatgcttcgtgaggcttcaaaggcccatcctgaaagctaggcatcccctgagagtgctctcacaaaaaccggcaaatcttttcccagccgatgcgggggtcccccagtggctgcagaggagactggtgctggaattcgacacgcgcactgttagggacaggtcagacgctgcctctgtcgtgctggcatgtggcgtgaggactcggaatttgattgatgccgactgcgcgacactgatagcagccggtgtcccccttgtgaatcgatacgtggtgacgaggcaccctgcggatgatccccgagtgcagggctatttgaggctcgccgggagggtgaccaggatagatggccccaacctgtacttggaggatcatggcgatggagcagctgtgatcaaggcctccatggcctatctggagcccaggagggagaacgtgatttggtgtgcccaccatttgctggggagaaatgcggatagagtactggcggaagcggataacgcagccgcaaagcacttgagcggtcccgaacgattggccgtagtgaagaagactttcgactaccttaggagccagaacatcgagcttgcgcctggagtgcccctcactctgggtaacgttgtggggaatgacaagggttcttggatcttccggacggaaactctgcccaagccccacctggtgttcgacccgagcgggacccggatcgataggtggaatgagaggggattggacgctcacgggccctatgatcaaaggaccttcacccctaaacaactgaggattgccgtcatatgtcaactgccctacgaaggccaggtcgatgcgttcctggcaaaatttctcgacggccttccagacgtgaagaccggctacggggaccgggccagggcgccttatgccaaggggttcatcaggaggtacggtctggagaagcccaaggtgagcaccttcgcaacaaaaggcgctactgctaaggactatgccgctgcatgtagggcggctgtggaggacgcaaccgcaagcggcttcgagtggaatctggctatcgtgcagatcgacaaggatttcaaggagctgagtgacgtggagaatccctacttcaccaccaaggccctgctgctgaagcatcgggtgcccgtccaagaggtgacgctggagacgatgaggttggcagacgaacagctggtgtacgtgttgaacaacatgagcgtagccacctacgccaaagtgggcggtactccctggctcttgaaagcgcaaccaaccgtggcccatgagttggtagttggaatcggaagccagacttttagtgcctcaaggctgggtgagaaagagagggttgtaggccttaccaccgtgttctcctccgacgggaaatacctgctggacgaccggactagcgccgttgattacgacaactatagcgaagagctgtttaagagcttgtcccggtcaatagaatcagtaaggatcgccgataactggcgaagtacggacagtgtcaggctgattttccatgttttcaagcagatggcggacgaggaagccgacgcggttgacaagttggtgcaaaagctgggtttggcacaggttaagttcgcgtttctgcacatcgtggatgaccacccattcgccctgtttgacgagaagaacataggtacaaagacatggggtgggatattcaagggcgtcttggcaccggaaaggggcctcgcggtaaacctctctggggccgaaaccctgttgtgcttcacaggcggcagggaactgaaacaggcgaaggatggcctgcccgtgcctagtctgctgcgactgcaccacaggagtacgttcagggacatgacctacctgacggggcaagccttcaacttcagctgtcacacctggcgcatgttcacacccgctcctgttcccatcacaatacattacagcgagctgatggcgcgactccttacgggcctcaggcacgtcccggattgggatccagacacaatgctgacccccatcagtcgaacccggtggttcctgtagtaa

SEQ ID NO: 76 - DNA, 2259 bp, Artificial Sequence
  Description of Artificial Sequence: Synthetic polynucleotide
atgcccaagaagaaaaggaaggtagaggatccaaagaaaaagcggaaggttggaagtggaagcctccccatcgtcctgaacgccttcccacttaaagtacccgaactggagctggaagttaggcaaataccgtacgataaagagacgcttgacggcctcagggctgcgcacaaggccacccacgctttccgcaggcagggcgacaacatactgattttttccggtgatggcacatttcccgcgtctgggacgcctcaaactattgcactgaaggacaatttcggcgtgttctacagcctcgtgaaggatggtcttatccgccaccttgcggggctcgggaggaatcccagcgggttcaaccccatagagttggtgtccgcaaaacccgaagacaacctgctggtccccatactcggcgatgcgtatccttttaaggtgtgcgcgaaatacagcattgacaccagaaccgtgctggggcacccatgtctggtgatcgattgcacgaccaggagggtgttgaaggaaaatggcttgttctttttgaacgctgggttcgacctcgcgggcaggtacgtggtgacggagcaagatgacgggtacaggaaattgctcggcagcgtgagcggctgtaagggtgaaacgctgtacgtgactaggcccgatggccaagtggtgcaggccgaggctaaaaacgtgtacctggaggcatcccgcacaaatttcgacgactatattctgcacacccacagggctcagaaggacgcgatcgttgaacgaatcagacagtccgtttccgtgtttaatgggggcgaaaataagaaagcccgaatcgacacgctgaagaagtatatccagtccaaaaccattcccttgatcgacggcaccaggattgagatccaagattcccctaacatacagaaagactgcggccagatgcaaaaaccggtattcgtctttaacgacaacggcgaggcggactgggcggagaaggggctgacccaatctgggccgtacaccaagaggaccttcgacaggaatgacccctccatttgcgtgatctgcgcccaacatgacaagggacgcgttgagcagttcgtcaggaagttgcttaagggcattccaaactccaaatacttcagcaacggtctcgaggggaagtttaccctgggcactagcagggtagaagtgttcgcgaccgctactgacagcgtagacgcctacaagaacgctattgaagccgcaatacggaagaaggccgacgacggcggcaggtgggacctggccctggttcaagtgaggcagagctttaagaagttgaaagtgaccgagaacccctactaccttggcaaaagtctgttcttcctccaccaggtgcccgtccaggactttaccattgagctgttggctcagtccgactactccctcggctactctctgaataacatggcccttgcatgctacgcgaagatgggcggtgtgccctggctgcttaaatcttcacccaccctcagccatgagcttgtgataggcatcggctccgccaacatcggccaggagagaggagctgataatcagagaattatgggcatcaccactgtgttcagcggagacggcagctatatcgtgagcaatacatctaaggctgttgtccccgaagcttactgcgaggcccttaccgccgtacttggcgaaaccatcgaaaagattcagaagaggatgaactggcagaagggcgataccatcagattgatcttccacgctcaggtcaagaaattcaacaaggaggaaatcgaagcggtcagagccgtcattgagaaatatcgggaataccagatcgagtacacttttctgaagataagcgaaaaccacgggcttcacatgttcgatagtgcaaccgcaggggtgcaaaagggccgacttgcccctccgagggggaagacgttcaagctgagcaaacatgagatgctggtttatctgatagggcagagggagctgcggcaagacaccgatggtcatcccaggggcgtcatccttgatgttcacaaggacagtacattcaaagacatcacctacctttcagcccagctctactcatttgccagccacagctggcgctcttactttcccaaccctatgccagtaaccatttcatacagcgatctgatcgctcgaaaccttggttggctgaaccaactgcccgggtggaacgactccgtgatgatcggaaagatcgggcaaagccagtggttcctgtagtaa

SEQ ID NO: 77 - DNA, 1986 bp, Artificial Sequence
  Description of Artificial Sequence: Synthetic polynucleotide
atgccgaagaagaaacgaaaggttgaggaccccaaaaagaaaaggaaggtggggagcggcagcatgaataacatacccatcaggctgaactttttcgccctgaagaaccagaacattagcttcaggatctacaggcaggacttcaacggccagaaaaaacaggacgggtactacaggaccaagctgcccatcaacgactcttctgacacctacgcggagtactgggtgacaacccagcccaaggatggcttcgagagggtgtactgcctgggttcctcaaaccctaagctcaccgtccgaatcatgtgggagagcttcctggatagggtccagaagtccctgagctccgacgaatatatcctttacggtaacggatttagccggaaggtcgccgtgatcatcggcaggcacagggagggcaatgaggtgatccagatagagccctattacctgaaggccgagaagaagttcggctttctggtggacttcgcatttaagaaggccaaggacgtgccctatagcatcagggttcagcagctgagcctgtcactgaacaagtatgggaagagcaacgccgactactatagcgacaagctggataagataaagttctttatgcagaagtttaagcagaggcttttcccatttagcttggataacgaggattacgacatcgagaacgagctgtatctgatgaggagctacccgctcaagatgaagacctacatattctctaatggcaaggaaagcaacagccaggtgcagggtctcaaaacctacggaccgctggcgaatctcgataaggagccactgttcgtgttcatgttcgagtcccaggacaggaacgaggccctggagctctattctagcctgctgggcaagacgtacaccaacatatttgctggcatggagagcgtgtacaaaatcaaactcgcaaaagagaatgtgaagcacatcatcatccccagccttaccaaggagggtctgcaagtggtggagcaagagctgcaaactatcgtggagagtcatcaggacaagaaggtgattgggatatttgtaatgaatgaaaaggtgccctcatccatcaccggtttcagcccctaccactacgtcaagtacatcttcacagagaaacgcattcccctccagacagtgaggtgcgagaggatcgctgccagggatggcctcaaatggagcgttggcaacatcggcctccaaattttcgctaaattgggcggcatcccctggaaagtcaagccgagtaacgataagtgcatcatttttggcctgggctgcgcccacaaaaaagacgaactgggaaacattaacaaatacttcgcctacagcgtgtgcatggacagcagcggcatttaccgaaagattaatgtgctcggcgatgcaaaggagcgcactgattacatccttcaactgcgggagaacatcaaaagcgtgataagcgagaatctggacgggagcattgaaaagtgcgtgattcacctgcccttcaaaattaagaacgacgagatcaggtacataaaatccagcgtgcaggagatcgcgcacctgtattccgacatagaatttcaatttatcaagatcaacacggacaacaagtttttcggatacgctgaaaacaacagcaaggtaccctacgagagcagctacatacaactgagcagcaacgagttcctggtgtggttcgaaggcctgcagtacgggaaggagctggtgaagaaaaaggtaggtaaccccgtgcacattgagttcatgcagatcgatgagttggatcccgaaaagaagcggcgatatctgcaggatatcataaacctgagcggtgccaactggcgaggttttaacgccaaactgtctccaatcagcatctactaccccaacatcatagccaatttcatttcagagttcagggagttccagcccgaaggcgacgtggacctgaccaacttttacattccctggttcctgtagtaa

SEQ ID NO: 78 - DNA, 2838 bp, Artificial Sequence
  Description of Artificial Sequence: Synthetic polynucleotide
atgcccaagaagaagcgcaaagtagaggaccctaagaaaaaacgcaaggtcggcagtggcagcatgcataacatcgaaatcaacaccttcgtcaacagctttgccattaaacccaacaactccatgtccttcctgctcggcgcaggcgcgtctatatcctccgggatcctgtctggcggacagatggtgtgggactttaaacggaacctctattgtgcgtccaaaaacatacgcaccagcaattttcccgatatgagcaaaaagaatgcgcaggacgagatccaacgcttttttgatgggcaggccggaaatcctagcctgtggtcctccgaggagtatagtttctacttcgagaggtgttatccggcgaggaaagacagggagctgtacatacagaacaaggtacgagacgtcaagccgtcattggggtatctctgcctcggggaattgatcatacacgagaagatcggtgtagtatcaaccacaaactttgatgacctggtgttggccggcatccattcaataagaccggacctgagtgtgaagaccatcagcagtgccctcaaaaatagcacgggattcttcgtgaacgacgggttcccgaacatcattaagctgcacggcgattacttgtacgataagctgaagaataccgataaggagctgcaaaagctcgagacggagatcagcggaatttttcgagatgccgtcaagagtggcgggctcatcgtacttggctacgccggcaacgacaacagcgtgatgagcgtcctggaggagctcgtaagctccgggcaaatcaggtacggcgtgttctggtgccaaccgaagggcttccccctgtccaagcgagcgcgggagtttattgagaaggcttgcgcctacaatgaggaatccggggttgtcgagatcaacaattttgacgactttatgtaccgcctgttccttacactcaacatccaaaactcatttatcgacagcatgtgggaacagagcggcatgaagcagccgatcctctatgagaatatcggacgacacaagtccaccgccgtgacgaacgccctgtgcgccctgcagtacccccgaaaatgctacgtcttcaacgcgaatatatcaagctggaaggaactgcgcgagacgataaacgacacgtgcgtggcagtgctgtataagggcatggtttgggcgctgggcagcaaagcaggcatcgtgcatgcgttcgccgggaagatcaatggagacatatacgaactcgacatcccgttgtacatgatgaaactcgaggattctgacatcctgggcatgttttacgacatcataggacgcggccttcagcgaaaggggctggtgagctacggtaataggaaacatcacaaatacttcaacccctccagcaaacggttcaagaacggtcaaaacatctacgacgcggtcaagatatcactgagtttcgtggacgatcagctcgtgctcatcctgctgcctacggtgcatctgctgaaacgcgacgggacggagctggagaaatttgactaccaaaaattggtgtcccaggagatggcaacacactacaacaaagtggtggacagcgagatagagatctggctgaaattcatctctaataacggcaagataatctttgagctggggaacgcaatactggaatttaacaacgtccgcatccagtactctggtaacggtaacctcagcaagtgctaccaggtgagcgagcccgagctcacgttcagttacgaaaaggacaactgcatcgctaccaaccaactgcggggtctgatcaactatggacccatagagacttacgtgaacaaagccatcaggttggctgtactcagccctaaggagtgtgccgcggacatttggaaacacctgcagaagttgaatgagcatcacgtcacctcccttattcaggatgcaaattttctgccggagtacaccggctttcagaacgtttttaggtgcaaccttgacattcccaatgggaacgatgtgcataggttcaaaggctacagtatagacaaggtcatgcaactcaacgcaaagagctacttttacgggatctgcaagtacattgatgcattcgagacacaaaggagccaatacgacctcctcgtcatctatatacctaagcagttgacccacatccgagaggccaagaataacttcgaatatttcgacctgcacgacagcctgaagatttattgcgctggtaaaggtatagtcacgcagatcatcgaggaacacagtgtttatactaacaatgacaccgccaagatcatatggggtctctcaacggccatattcaccaagaccgccggaaggttgtggaaacccagacgctattccatgaacaccgcttacgtcggcctgtcatatgtgcagagcgttaagaacaacgagaaagtcagcatcggttgcagtcagctgttcgacgccgaaggcaatggaatgaagctttacctgagacccttgatgaacccccagataattcaaaataacccttttatgcggagcgacgacgcttgcaggcttatgtcaaaccttaagcggatgtatgacgacagtgtcccgctctacaaactgaataggatcgtgatccacaaaactacgttcttcactaaagaagagatggaaggcatcaccaaagggctggctggagtggatgacatagagttgctccagatccaggagttcacagcttggcgagcaatacgcttcgactacgacaagatcgcaccgtttccgatacagaggggcacagtgattctggggtggggccactttagttacttggatacctggaagtgtaccacctagtaa

SEQ ID NO: 79 - DNA, 2178 bp, Artificial Sequence
  Description of Artificial Sequence: Synthetic polynucleotide
atgcctaagaaaaagcgaaaggtcgaggatccaaagaagaaacggaaggtgggcagcggctccatgcaagaacacctgaagacgaacatactgaactttaaatggcccaactctgctccgaccatctacctgacattggaggacattgaggggagccaccctatccacaaaagcaaattttctagacagataaaagaagtgttccccgacgcggatttgagtaacaaggaccagatctttacgacattcacgaccgaaatcccagacgccccaagcataaaactgaaccttgtggacggccgagaattgcggatctataaacagttcctcaagcacaagctgcggtcatatttcaaatctaaggactacatcgtggtcaagaatttcgtgggcgacgttcaagtgtggatgccgagcaaaaagggtaacaccgcagattacaacctgtactataagtttagctttaagatccaatttgccaaactgacggacctccccgagctgatcgtaagctacgatggcacctccaaggtgctcacgacgtccgttaaggacatcgaagattcagagctcatcaagcgatgcgtctacggccaaaagacgtttaactaccaaatggacttggacaccgaagagaagcaagagttttacaacgcgatacagtttgaccaggcctacccaattttcaacctttccctggcaagggcactcgacatccccatagaggagccaataaggccgatcaacaaataccaaaaatacgtagccctgattaacaatttcgcaactaattaccttttcaaggaggacttcaaggttatcttcccgtttaaaacagacacgttcatcgacgtgcctataaatcggataaatcacatcgacccccaagtcggcctgttggaattcggaaaagatcaatatggcaacaagaaaacccacctggtacctaaaaaggcaatgaacatcttgaatccataccggcgacctaataatcagaacatcaaaatctttttcatctgtcacacaagccacaaagactccgtgctcagcttctatcagaatctgaaggaaggagtaaacacggagaagaactactacaaaggacttgaagcctacgtgaacattaaggcaagtagtagcaaggagcattttatcgagttcacgaacgagaatgaccccatcccggagatcgtggagaagcttgagagcctcacatttgatcatgacaatgttctctacgcggcgttctatctctcccccttcgacaaattcacccagaatccggaggaccgggaaatttacatccaaataaaggagttgttcctgaacgaaggtatcgtgacccaagttgtcgattacgagaaaatggtcgtcaatatcgagaatcagtataacttccagttcagcctgcaaaacatggccctcgccattcatgctaagctgggcggtgccccgtggaagctggccgtgaccgacaagaaggaattggtcatcggggttggagcgtttacaaatcaaggcgagaacagacgctatattgcttccgccttctcctttcagaataacggcctcttccgcaagttcgagtacttcgatcaaagcgagaccgacctcctggctggcagtatctgcaaagccatccgcgacttcaccagcgtagcggaggcagataaggtcgttatccatttctataaggagatgagttacgaggagcttaaacccatcattcggggcatgcacacgcttgggctgaagatacccctttacatacttaacataaacaagactgaagccgaggatattatcgcctacgacctgaattggaacaaaaagctgatgcccgtcagcggcacctacattcgcatctccgaaaatcatttcctgctcttcaataacgcacgatatcctaattcccaacggtacgccgacacggatggttacccgtttcccattaagattaaggtcagctctccggacgaggatgcctttgaagatgcagatgtggtcctggagctgcttactcaggtttatcaatttagtagactgtattggaaaagtcttcgccaacaaaatgtacctatcaccatcaagtacccagagatggtagcccagattgccccccatttcaacaacggggtgcccgacgatgccaaggatgctctgtggttcctgtagtaa

SEQ ID NO: 80 - DNA, 2922 bp, Artificial Sequence
  Description of Artificial Sequence: Synthetic polynucleotide
atgcctaagaaaaaacggaaagtggaggatcccaaaaagaagcggaaggtcggcagcggctcaatggcctatccaatcgctgacgaccggcgaaagtacttccacagtcttttcgagaacaaggagccgtacatcggatacaaggctctgtgtctgctggccaagaacgacatcatcaagagcgtgtggacgaccaactttgacgggttgactgtgcggaccgcattccaaagtaacttgacccccatagaaataaccctcgacaacgcagacagactgtttaggaaccaaagcaagagagagctgctgagcatatcacttcatggcgactataagtatagcacgctgaaaaataccgagaaggagttggactcacaggacggcaccttcagcgagcatctgggtaactatcacgtcgacaagaacctgattgtgataggttattcagggcgcgacaaaagtctgatgaaatccctgaacgatgcattcaccaagaggggcaccggcaggctgtattggtgcggctacggtgacaagatcaacactgaggtggaagaacttatacgcaacgtacgaaccgctggaagggaagccttctacatatccaccgatggttttgataagacgctgatcgacctttctaaaagcgctctggaggacaacagcatgagcctcgaaagccttaattccatcctgaaactggcaaacaacgaggagctctcaaagatcgaatttagccagagcatcaccaggaccgacaaatacctgaagagtaatctgcacgcaattgtgttccccaaggagatattccagtttgaagtcgagtttggcgacaacaagccctggtcattccttaaagacaaaactaacaacaccgacatatgcgccatccccttcaagaggaaggtttacgccctgggcacgctcagcggtatatctagcgtgttcaaaaacgtgctcaaaagcgagattaggagggtaccaatctccaagttcgacatcgacaatgtgagcagctttaggtctctcatgatccaaacggtgatcaagcactttctgtcatacggaatcttcgacagcaacctcaaggacaaactgtggcttagaaattccgacaattccttcggggacaagaaaatacacaaggcgatttacctcagcttctacttcgataagagcagcaaattcggctacattagcttcagccccagcatacacataacctccgataacgagatcagcaaggaggtgaaacaaaggattagcaaagagatcttggaaaagctccgaaacgataagtttgacgaaatactggagtactggaacaccatactgttcaattacaaaaatcttaagttcgagtacccccttaacagcgggaccggattcgagttccaaataagccgaaacactgcgtttgccgaaatcatggtgctggacccgaactatcgagtctataaaccaagcgattacaacaacaagctgacccagttcagaggtgtgcagtatctggagccgcaactgatctttcagaactcactgagtaactcccacaccaaggactaccaccccatgagggcgttgaccaataacaggccatacgacaacaacttgaatggcatcatctattcaaacgaggtcaatttggccgtgatttgcggggaaaactactccaaaaacctctacgacttcctgaaccagcttaaccttaaacaccccacagacaacatcaaccccgatttccttatagaatatcctggcttcgcgagcgcctacaacctccccatcaacatcccatactatgaggacgcggacaagtggattaacatagatttggagaagagcaacaagtccgacagcgagaacgccatcatcgttgcacgcctcatcacaagcaaaatcgagcagatcataaacatacagtctcagcacaccatcgtcatcttcatccccaaagagtggcaggccttcgagagcttccaggaaaatggcgaggacttcgacctccacgactacatcaaggcgtttagtgcatccaagggcgtgagcacccagctcatcagggaggagacactgtcagacaggttgaaatgccaggtctactggtggctgtctctgagtttttatgtaaagtctctgcgcacgccatgggtcttgaataatcaggagaaaaacaccgcctacgccggcataggctacagcattaagaagaacagcaatgacaccgaggtggtgatcggttgcagccacatttacgattctaatggccagggcctgaagtacaagttgagtaaagtagataattacatcctggataagcagagcaatcccttcatgagctataatgacgcgtttcagttcggcgtgtcaattagggaactgttctacaatagcctggacaggctccccgagagggtggttatccataagcggaccaagtttacgaacgacgagataaaaggtattactgccagcctcaacatggcggggattaccaagatagatctcattgaaatcaactacgagacggaggctaggtttctctccatgaacgtattcaacggccttctgggcatagacaaattccctatcagtaggggtacctgcattattacgaataagtacgaagccctcctttggacccacggcatcgtgccctccgtgaagaatcccattcacaagtattacctgggcggcaggagcatcccagccccgatcaaaattactaggcattacggcgagagcgatctgaatactattgccatcgagatcctcggcctcaccaaaatgaattggaatagctttgacctttacagcaagctccctgcgacgattaactcctcaaatcagatagcccggatcggtaagttgctggcgcgctttgagggcaagacctatgattataggctctttatttagtaa

SEQ ID NO: 81 - DNA, 2175 bp, Artificial Sequence
  Description of Artificial Sequence: Synthetic polynucleotide
atgcccaagaagaagcgaaaggtagaggacccaaagaaaaaaaggaaggtgggctccggatctctggacagtttccacctcgtgcagacagagaaaaaggccatcgcaatgccaaagcagaagcttgcggttaatgcactccccattagcctgaaagagcaggagcagcacaagctgttcttttttagcaaggaaaagcagggcgagcgagccccgctcaccaggaaagaatatcctgacagcttcgccaagaggtaccccaagagctccaaagagtacgacgtgctgtacacggacttcaccccagagccagctgaggatgggtttgaaattgatatcgacctggaggaggcacctggccttgccaagcactacttgcacaaaaggatctttgaggcctttaagggagtagctgacttcagaaagcgggatttcatcaacggtgtggagctttggttcagggacaaacccgccgacgaagttaatttccgggcctacaagaagtttaagattaccacccgcagaacttggttctccgcaggctgggccctgttcatacaatacaccggccattcctttattcacccggtggcgatcaatagcgaagaggccgcagtggacactacggaactcacgcgggttgcttataaccgacacatcttccactacgaggagatccccgaagacaaactgagtgagatagatttcagtaagatgtaccccgtggtgaacttcaacattagggataaaatgcagcagttccccgttatcgatccattcaaaaacaaggtcaaggaatatgtcgacgaaatagacaggttcaagaacatgtatctgatcgcgccagcggttgaggaggtgcttccgtttactttcaacgacgacaactggtgcgagatcaagatcggcacctaccataccgtgcccaatgccggttccaaattggttttccgcgatgggcaaaccgagatacacccgttctacggtatcaggaaccacggccctttcatgccccccaaacacagccacataaggtttttgtttatcatgagcaagagggacatcaagggcgctggtaagcaattctatgaatacttgaagggggaggtaaaaggagtggacgggttcaacaggtatgctaatataccgtcatccctgaggggtgagatgatcgagtttgagaacgagcaaaaccccctgccggagattatcgacggcttgaacaacatggagcgagaagcgggcgtggcctacttcgccttctatatcagccccatcgaccgagaagtgaggaacaggaaggagaggttggtgtactacagggttaaggaggagctgctgaagagaaagattgcctcacaagtggtagaaaggagcactatcgagaaggccgacttccgctacagcatccccaacatcgccgttgccacagtggccaagctgggaggcatcccgtggaagcttactcaacccccagaagcagagctgatcgtgggcataggcgcattccagccacgcgagttcgacaagcgatatctgggcagcgccttttgcttccaaggcgacggaacctttagcggcctgaggtgtttcaccaaggacgaaccccatatgcttgctggcagcatcagggaagcggttcaaaggtacgccgatgaaaacaggcaagtggaacggctggttatccatttctacaaaaccatgagctatgacgagaggaagccgatcctggccaccttgaaagaactcggcctggacattcccgttgtggtggtcactatcaacaagactgaatacgagcagacaatcctctttgacctgaattctagcatgaggctgccgctgagtggtacctatttcagccagcgcagggacgacatcctgctgagcaacaacaccaggtaccgcaaagacagcgaggtgaagaggggtttcccttttcccgtgagactgcagctgtggtgctccaaggagggcctgctggacgacgagggttttagggagcgactgatcacccaagtgtataggttttctcggctttactggaagagcgtgtctcaacagaatctgcccgtgaccattaagtatcccgagatgctggccgaaaagttcccatactttaactcaaggagccttcctagcttcggcgaaaaaagcctgtggttcttgtagtaa

SEQ ID NO: 82 - DNA, 3195 bp, Artificial Sequence
  Description of Artificial Sequence: Synthetic polynucleotide
atgcctaagaagaagcggaaggtggaagacccgaagaaaaaacgaaaggtgggctccggaagcatgaacaacaccataaacaaaatagacttcggcgcgtttctgagatcattcaagcagaacctggacggtagcttttctttccttctgggagcaggcgcgagtgtgagcagcggcgtacagtctgcaagcgactgcatttgggactggaaaaaagacatttttctggcccaaaaccttcaatttgaggagtttctggacatccatagtgacttctgtaaagataaaatccaaaagtggttggatgagcagggcgtgtttcccaagcgagactcagaggaagagtacgtgttttatgccgagaaagcgtacccaatggaacaggacaggaccaagtatttcgagaacctttgcgcggacaaaaccccctacatagggtataaactgctgatgctgctgaacaaatacggagttctgaaatccgtgtggacaacgaattttgacggtctgatagaacgcgcagcgcaccaagccgatctgacgcccatcgccgttaccctcgacaaccccgaaaggattagccgaaacgagagtaaatctgagctgctctacgtggcactccacggtgactacaagtatagcaagctgaagaacacagcccaagagctggacgcgcaagaaattctcttcaccgaacgcctgaagtcttacttcatcgataagaatttggtggtgatcggttacagcggtcgagacaaaagtttgatgcacaccttgtgcgaggcttttatgacgaaggggtgcggtcggctttactggtgcggctacggtaacaagattacctctgaagtgcagaacttcctcaacagaataaacgattcaggtagggaagccgtgtacgtggacaccgatgggttcgatgccaccctcgtgtctattatgaagttttgctacgaggatcaattcgacaagaaaatcgaaatcggcaagtatctcaagggcctgtcaagggtgaagcatattatccctttcagcgttgagaataccacgttcaccggctgcgccaagaccaacctgtaccccttgatcatcccccaagacatattccagttcgagatagagagccccgaaggtagcagcaaatggaccttcattaaagagaagattaagggcaaggacattatcgctgccccttacgagaaaatagtctacgcatacgggctgccaaactcaatctacaacgtattcagtaaggagctgatcggcgagatcaagagggttcccatcagcctgagtaacatcaaagacaacagcaccctcaagaatatcatcctgaaggtgctgatatgttctctgagcagtaacgcgggactcagggcgagtatgagcaagaagatcatctggaatgagaaagagaggttccagagcaacgtttttaaggcaataaagatcgacatcgttttcatcaatagcgaaaagtacgccctcatctcaatcacccctaccctctatttcaacaaggagggcaactacacgacgctgcagaagcaggaaattacgcggagctacattgacaagctgtacaataagatttatgaggaaaccctttgttactgggaggccatcctgtttaagcagcagaccaagatctgcttcgactacccgctcaattccgggaacggctgtttcttcaaggttagctctaacaggggcgaagccctgttcaataatccgaataagccgtacgtgattactaacgacatcatacttaaacgcaaaatctacgaaggcatcataatcgacgagcccctcctgaacttctcagggtcaaccagcgcccacatcattatggactccaatccgatgcgcggtctcaacaacaataacccatatgatcacttcattgcaagcaagtttagggacgtttctatccacatcggagtcgtgtgtccctgtacatatagcgacaggttttttagctttctgaacgagctgcaaagtccgataaagaataacaatcctaactcagactacatccagaactataacggattcagccagatatacgcaagcattcttaatatcccagcgatcaacagccaatactggatctcatgccgcgaagagcaggataacagcatctctttggctaggaacctgtgtaaatacgcgaaccagatggccactaacatgccaggtataatagttaccttcttcattcctaacagctggagcaaccacaagagtttcaaagaatgtggcgaggtattcgacctccacagttacatcaaggctttcgccgcacagcacggttttacaacccaaatcattgaagagcgaactctcacaaatctctccatgaaaaaggagatctattggtggctgagcctggcgttctttgtaaaggctatgcgagtaccatggaccctggccaatctggaccagaacaccgccttcgccggcatcggctactccctgagcaaaaagcaaagcggcaaattcaatatcgttatcggctgtagccatatctataattctgagggccaaggcctgaggtacaagctctcaaagatagataatccaatcttggaccggaaaaacaacccgtacctgacctataatgaggcgtataagttgggcgtgaacatacagaatctgttcattcagagcatggacaaactcccgaagcgagtagtgatccacaaaaggatcccgttcctggaggacgagataaagggcattaccgaggcgttggcccaggccaacatcacgaatgttgacctcatcactatcacgatcgaaaagaacatcagatgcctggatcagttcttctacaatggtcaagccaagaacagcaacttcccactgcataggggcacctgcatgaagctcagtgataccgagtgtctgttgtggacccacggcgtggtggactcaattaaggcgggcaggaactactactctggtggcaagggtatcccctcccccctccgcatatcaaagttttacggcgcaggctctatgaagactatatgcaacgaaatcctggggttcacaaagatgaattggaatagctttaacttctataccaagcttcccgcgaccatcgacaccagcaacacgctggcgcaagtggggaacatgctcgataattacaacggtattacatacgattacaggtatttcatctagtaa

SEQ ID NO: 83 - DNA, 2358 bp, Artificial Sequence
  Description of Artificial Sequence: Synthetic polynucleotide
atgcccaaaaagaaacgcaaggtcgaggaccctaagaagaagaggaaagtagggtctggctctatgcaactgaactatttccccatccagtttgacttttctgactaccaggtcatcacgcagccctactccgacgagagattgaaagaactcaggcaggcctacaacgccagctattccttctttcgggacggcaaccttatcgtaatttccaataaagaggacgaggaaaaccaattgacgggcaacgtcgaaaaccgcagcgtgttcgacgatgccaaagttaccgccagcatggtcaagcatatattctttaggacgttcaaggacaggttccaaggcttcatccccgtggacttttaccccttccgattctacagcagacaagagaaggacgaccttattctgaaccacctgcccgaaaaacttaagcataaaatcgcctttaagaaactgatcgaggtgcagctcagggagacgaatcttaattcaacccagggctttgctttcgtcgtcaacatcaggagaaattgggtgtttaacatttcctgtctcgagctttatcaggaaggctttgacctcacagattttgaagtgctccatgcggagacgcttcccgggttggacaatatcctggccccgaacgaggacttcgttggccttctcaagagcatcaacggcgagactgccattgtgagcactagcgagggtgcccgctcctattcactgcaggagctcttcattcgcaagactaagcacaacatacaggcgtacctcaacttcgccaccggggaaaaaaagtgcgaccagatccttgcagccgtgtcccaggaacgaatccggaagcagaaccccgtgaatcaattcagcgagatatccaacatcgcgaagcatcttttttcagacaaaggcaatccagtgctgttccagaatatggatggcttttgttttaaagttgacaccacgccgatgcaggtacaaaactccatgaacctgcaaactcccacgttcatctacgaccacgcgggtaccaagacgaacacccgcaacgcggaccaggggctgagctactacggcccctacgatagcctcaccttcgacattaagaagccaagagttctctctatctgccataagaccaaccgaggctcctttacgcgcttcctccacgacctcaaagacgggctccccaatagcagctggttcaagaagggcctcctgaagaagtacgagcttcaagaggtgaattacctcatccaggagatcagcgactacaggttggaggactacctggaagtgatctcaaactacgatgatgagaagccgcacctggcaatcatcgaaattccagataggttcaaaaaactgtccgaccgggacaacccctatttcaagattaaggcaaagctgctgagccttgagattcccgtacaatttgtgcgcagcacgactttgagcagctacagcgaatacatacttaatccgcttgcattgcaaatctatgcgaaactcggcggcacgccttgggttcttccggcccaacgctccgttgaccgcgaaatcgttattggcataggtcactcatggcttcggagtggcatgtataagggtgctgaaaacagcagggtggtcggcattactacgtttatgtctagcgatggccaatacctcctgggcgacaaggtgaaagacgtgccttacgagtcttacttcgaggagttgctgaagagtctcaaaagtagcataagcagactctccgatgagtatgcctggcaggatggcgacacagtgcgcctcattttccacatcttcaaacccatcaagaacgttgagttcgatgtcattagccagcttgtgaaggacatcagccagttcaacataaagttcgcgtttgtgaccattagcaagtcacacccgtctattctctttgacacgagtcagcaaggcgagaaaaagtacggctctaaccaggtgatagggcagtacatccctcagaggggtagcaatatcttcatagatgacgaaaccagcctggtgcagatgctgggcgccagggaacttaaaactgccaaacacgggatgagcaccccaatccaaatcaaacttaggacaccgcagggtaaccataacgaccaagaactgaaggatttgatgttttacgatcttaactacattacccagcagatctatagttttacttacttgagctggaggagctttttgccacgcgaggaaccggccacaatgctctactccaacttgatatcccgacttcttgggaagatgaggagcatccctgaatgggatgcggataagctcaattatacccttaaaaggaagaaatggttcctgtagtaa

SEQ ID NO: 84 - DNA, 1941 bp, Artificial Sequence
  Description of Artificial Sequence: Synthetic polynucleotide
atgcccaaaaagaagcggaaagtcgaagaccccaagaagaagagaaaggtgggctccggcagcgtgggcgacaagaccttcagcttcaaggtgtataggaaactgaaacagcagaacgacaccaaggaagacgagatatacctttacaatttgccccaaggcgagaccctgaatgattacaagccatattggatcagttttaccccgaaggacggattcgaagaatacatcgctaattcttacttgagcatcggcctgtcaaaaaagtacctgttcaatagattcgtggagacgctcagcaactcaaaactgcacttcacctacaaggtcaaaaggaaattcaccgactggtacgtcgatttcgtaatcgcgcagtacagccagggagacaggatcatctacatgagcccctacttcctggaagagcaaaacacctacggcttcatcatcgacttcaagttcagcaagaaggatggtatccccttcgataaggaggtgcaaaagctgtccctttcactggatagcaacggccgcagcaacaaaaactattactctgacaaatttaggctggtgaacaatttcattaaggagatttacacctccataaagaacatcgggaccagtaataatcctatcaccatttccagcaacctcatagagaccaccgtgttccacctgaacaagaaagagtacatctttagcaataacaacgtaagctctagccagttccagggcgtgaggaatttcggtgtctataagaatatcccccaggacgtgatcttcgcgttcatattcgaggataggttcaggagcttcgccaacgagctgtatctgagccttaccggaaaattgaaccccgggacctttcccggactggagcagatgttcggcatcagcatcaacaccaaaaacgtgagacagatcaagttggagaactactctctggattcaatgcttagggtggtgaatgacgtgaagagcttgcaggagaacaatcccgataagaagatcgtgggaatctacgtggaagactgcaccatcgacagcgaggacatccctgcgtccaacaactactactttctgaagtatcactttatcaaaaatgacctgccactgcaggttgtgaattatcggaagctgggcgaaaggaattctctgaaatggagtacctccaacctggccctggccatgttcgcaaagatgggcggcatcccctgggtcgtaaaaccgtctaataagaactgcttgattcttggcatcggatctagtcataagataaaccgggagaccggcgatatacttaaatactttgcatacaccatatgtctcgactccagtggcctgtacaaggcccttgaggtgctggccgacgaggagagcgaggtgagctaccttgagaagcttactgccaatctggtcgccatactgaaggaacaaaagaccaattacggcacctgtgtgctgcacctgcccttcaagattaagaaaaaagaggtagccgccattagtgatgccataaaacaaatcaacgacatcgagctggtggtggtaaagatcaatgtggataacaagtatttcggatactccttccacaacacattggtgccctacgagagcagcttcgtgaagctttctaaggatgagtatctggtgtggttcgagggcctgctgtacggcaaagagatcgtagataagaggttgagcaaccccgtgcacatccaattcttgaacatcaccaacaggaagaacttcgatgagcaggcgtttctgcaggacattctgaatttgagcggagccaactggaggggcttcaacgccaaaagcatccctatctcaatttactattctcaaatcatcgcgaggtacaccgaggccttcgaaaacatcgacggttacaaggagggtactatctctaacgacaaaccctggttcctgtagtaa

SEQ ID NO: 85 - DNA, 2286 bp, Artificial Sequence
  Description of Artificial Sequence: Synthetic polynucleotide
atgccgaagaaaaagcgaaaagtggaagaccccaaaaagaagcggaaggtgggcagcggcagcatggacaatttggctctctctgcgcttcagctggacagtagattggatcactgtatggtatatcaatacaggatcgtgtaccataagttcgacgaaacagaggcgggtgaaaaactggcaagaaaggccgcctacgaactgtggaaggtaaacaacttcggactgctcaccaacctgggtgccagtagcatcctgtcccttaagagcctgagtcagctgtctatcgattcaccgctgttgcaggcaagtttgaaagctgacggccagttggagctggattgcggtaacgaacagcatcaggaggcgctgcagagactcgtgaaccaggacataaacaaagcggcttggaacctcaaacaagcgagcgaggggaagcttgattgccgaaaatcaccaggcgggcacgccgaaatcttcgagccaagtcacagtagtcggatcaaggcccacagtacctatttggatgccttctgcaccgtaaggctgattcccgaagtgctgtcagacgggacagtgctgatagggttgcatcttaagcacagcctgaccgcgaaggcggacatctctcttcagtgggtcattgatcataggcccgattggctgatatccatagagaaggtgcgccacaggtattacgagcccggcaaagcacccctcgttgcggagttcgtgaaagtcgatgattccatcaacggatcatcccttctcccacacttgggcaaatcccttgtcgcttaccaccaggagaaagggctgctttcagccggacagctcgcagaggcagccaccagctcactcatcaaagtgcgctacggacagaaggaggcagaccacgttgctagcttggtggaacccatgtttgatttcgatactctgtcaaagattgacagccccttcctgaataggctcgccaaagacctgaagtggagcttggacgatagaataaagacaagcgcggagatggtcaagaggctctacctgcccgggtttaatcgaaagttggtacaagttgactaccagaatctgagcaggaagaggttcaaccacaaccttatgctccagttcgcggatggggcaaggagcggccatgaacaagacgtcctgaaatacaaggctttcgccgacatgaccagggctagggtaatcccactcgtggtaggagagaggaacaacaccgaaagcaatagacaattgctccggaacgcctataacgcactgaggcaacttaccaaggccgaattgccccccttcacgtcatttccccccagcatcggaaacgccgacgagttggacgcacggctgcacaagaaatgtcccgacaacgccatcctgcttatcgggctcacagagaagagtgacaaagccgcgatcagggacacggcgttcaactacggcctggccacccagttcatgaggctcgatcacaagcccaaggtttacgacagcttctacttcaataacgtcgcagcgggcctgttctccaagggaggagggcaactgtgcgccgtgaacgacatgcccggtgagactgaactgtttatcggtctggacatgggcggcgtgaatgtaagggcgccaggtttcgcattcctgtttctcaactctggcgcgcaactgggctggcagctggctgacaagcagcagggcgagaaaatgcaggacgacgctctcagcaatctgctggagaagtctctcaaaacctacctgaggagcaccgacgggcttttgccaaggaggataactctgcacagggacggcaggttttacgagagcatcaatgtgatagaacagtttgagcagaagcacggggtcaagctcgatgttctggaagtcttgaaaagcggagccccggtgctgtaccggagagaacgcagtgcggacggtaagaaagttttcagcaacccaggggttggcgatgccgtcttccttagcgacagggaggtcattcttagcacttacagcggcgaggaacttgggaagtcatggggtaacaaggtgagtgtgaggccacttcgactccgaaagagatacggcgagaccgcattgagcgtgttggcccatcaggtgttggtcctgtctaggatccatggggccagcctctaccgacacccccgacttccggtgaccacccaccacgcggacaggttcgcaaccttgcggcaagatgcgtgcatagacgcacttagtaagatggatagactgtgtccggtgtatctgtagtaa

SEQ ID NO: 86 - DNA, 2451 bp, Artificial Sequence
  Description of Artificial Sequence: Synthetic polynucleotide
atgcctaagaagaagaggaaagtggaggatcccaaaaagaaacgaaaggtcggcagcggttctatgagcgagctggagaccaacatcttcccaatcaccaacttgcatgagcttgaaagcaggttcaggttgtatagggtgaggggcctgagcatcaaccaagaggagtacgaccccaacacccagacattggtgaggaagctgagctacagcatgaggtctcccgtagctgtgatacttaggaacagcgacccgttcctggctcttccaatcgacgcacccgagcccatctctccgtacccgctcgtgagagccactgctgtgttcgagaagacggacgaggtatttactctcgattacgaaagcccaactcccgagacagatgcgctgcgaataaggttcctgcaatttatcatccaaggcgcgctgtttaggaatcccagcctgtggcagccctcagctggcacccccttcttcgagaggagccccgtgttggagaaggccggcatttgcgcgtaccgaggcttctcagtgcgagtcgtgcccatagaaggtggtaaactgggaatctgtgtggacgttaagcacaggtacgtcagcaaaaaccccatcgaagcaaacatcaagcgcgaggaattcaggaaatacaagaacggcaggtgcatataccactacggccacaactggtacgagatcaagttgcaagaccacactgggctgtccgtgtcagagcagatgatcagcaacgggacggccaaacccataagcttgtatcagttcattatgaataacgcgcccaagcccctgcccagggaggtcatagacatgcctcccgactcacccgcagtcaaatacatgaccagcagggatgaggtgcgctacgtgccctccatcctttgttatccggtctttgacacctctgaccccagggtgaagccgacgcataggggcacaatcctcctccctaacgtgaggcgacagtatatccacaatttcgtgaactcacacctgaccgatgtgcgatccaaagacatggcaatccgaatcagcagcaagccagttatcgcccctaccaagattttcctgccgcctgacctggcattcggcaacaacaccgtgttcagcgtaagaggcacacccgggaccacgtatgttagcctggagcagctgggccagacgcggataagcgccctcttcaatcagaaaataggcccttatgacagcaggccgctggataggcagtacatgattctgccgaaaagcgtgtgggactcccacgggccagtatttctgaatgactttaagaaaatcatgaacgagctgtacctgcacgaactgccctacaatcccatcgtcgtgacctacaacgacttgagcgccaagacctacgcgcttcagggaagggctattctggacgccgtggacagcgaactgagagagccgggatacggcgtggttatgatacacgagacggtggaccgccggaatagacagcacgaccagcttgccgcgatggtgatgagggagctgcggaacaggaggctgtatgtgagcgtgatccataccacggtgacgaaggactgttaccaattgccccagaacgcccccattggcaaggcctactgcccggtagcaggcaagcagggcaaactcaatggctacttgaggaacgtggccattaccaaggtgcttctgaccaacgagaggtggcccttcgttatatctaccccgctgcatgcggactttaccgttgccttcgacgtgcagcttaacaccgcttgcttcacattcatcggcaagagcggctccgacatccggaccgttttgaagaccagtaaccaaaaggagaggttgagcaaggcacaagtaaggcagacgctcctggaagtgctccgccaggaggttggcttcggtcgacggaccatgcagaccatagtggttcagagggatggcaaattgtttgccagtgagatcgcgggagcaaaagacgctatagagatagtgaagaaagaaggcatcttgcccagcgatgtgtcactgaatttcatcgaaatccccaagagcagcgtcgccccatttaggctgttcgatagcagccccaggccagggcagcctgaaatggcgaacaacccaagaatcggctcctacttcatcgcgacgaattacgacggttacatttgcaccaccggcaaggagttttaccatcccggtacggcaaatcctctccacgtgaagtacatcgagggaaatatgccatttgagaagatcctggaggacgtgtacgccttgacttgcttggcgttgaccaggcccgaagactgcacaagggaacccttcaccatgaaactggccgatatccgactgagggaacatgccggaggctacgacgaagatgcattggcgtatgatgatgaaaatgagaacgacgaggataacgagaatgaatagtaa

SEQ ID NO: 87 - DNA, 2310 bp, Artificial Sequence
  Description of Artificial Sequence: Synthetic polynucleotide
atgccgaaaaaaaagcgcaaggtggaggatccaaaaaagaaacggaaagtgggatctggctccatgaactacacagaggccaagaccgccaatagccccttgttccttagcgagattagtagtttgacacttaagaatagctgcctgaattgttttaagctgaaccatcaggtcacccggaaaataggcaacaggttctcttggcagttcagccacaagttccctgacgtcgtggtagtgttcgaggacaattgcttttgggtgctggctaaagatgaaaagagtttgcctagtccacagcagtggaaggaagcactgtcagacatacaggaagtgctgagggaagacattggggaccactactacagcattcactggttgaaagacttccagataaccgccctggtcaccgcgcagctggctgtgcggattttgaagatatttgggaagtttagctacccgatcgtgttccccaaggacagtcagatctctgaaaaccaggtgcaggtgcgaagggaagtggatttctgggctgagataatcaacgacacggacccagcaatatgcctgacggtggaaagcagcatcgtttactctggcgacttggaacagttttacgaaaatcatccgtaccgacaggacgccgtgaaacttctcgtagggctgaaagtgaaaactatcgaaaccaacggcatcgcgaagattatcaaaattgccgggaccatcggagaaaagcgggaggaactgctgaccaaggcaaccgggtccataagcaggcgcaaattggaggaggcacacctgggccaacctgtggtggccgtgcagttcggcaagaatccgagagaatacatctatccccttgccgcgctcaaaccgtgtatgaccgacaaagacgagagcctgtttcaagtgaactatggcgagcttctgaagaagactaagattttctacgccgaacggcaggagttgctgaaattgtataaacaggaggcgcagaagacgctgaacaacttcggcttccagctccgggagcggtcaatcaatagcagggagaaccccgactttttctggaccccctcaatttcccttgaacaaacgcccatcttgtttggcaaaggtgagcgaggtgagaaacgagagaccttgaaaggcttgagcaaaggcggcgtgtacaagagacatagggagtacgtcgaccccgcgagaaagattaggctggccatcctgaagccggccaatctcaaggttggggattttagggagcagctcgagaagcgactgaagctctataagttcgagaccatccttccccccgagaatcaaatcaattttagcgtagagggcgtgggctatgaaaaacgagcccgcttggaagaggccgtggaccaactgattaggggggagatacccgtggatatcgctcttgtctttcttccgcaggaggaccgaaacgccgacaacaccgaggaggggagcctttactcatggatcaagaagaagttccttgacagggttgtgataacgcaaatgatctatgagaaaacgcttaactataagaacaattacaagaacatcctcgatcaggtggtgcctggaatccttgcgaaacttggtaatctgccttacgtgctcgcagagccactggaaatcgccgactacttcattggcctggatgtgggtcgcatgcctaagaaaaacctccccgggtcacttaacgtgtgcgcgtccgtaaggttgtacgggaagcagggcgagtttgtgcggtgccgagtcgaagatagtctcaccgaaggtgaagagatcccccagagaatcctggagaattgtctgccccaagccgagttgaagaaccagaccgtgctgatatacagggacggtaagttccagggcaaggaggtggataacttgctggcccgagccagggccattaagagcaaattcatacttgtcgaatgctataaaacgggcatccccagactgtataacttcaagcaaaaacagatcgacgcgcccagtaagggcctggcgttcgctctgagtaacagggaggtgatcctgatcacgtcccaggttagcgaaaagatcggcgtgccgcgacctctgaggcttaaggtacatgagctgggagagcaggtaaatctgaagcaactggtggacaccacactcaagctgaccctgctccactatgggtctcttaaggacccgaggctgcccatccccctttacggcgctgacatcatcgcgtataggaggttgcagggaatatatccctctttgctggaggacgattgtcagttctggctgtagtaa

SEQ ID NO: 88 - DNA, 2196 bp, Artificial Sequence
  Description of Artificial Sequence: Synthetic polynucleotide
atgccaaagaaaaaaaggaaagtcgaggaccccaaaaagaagcgaaaagtgggcagcggctccttggacaattacatactgaccgagtacaaggccggcatccacgccagcgagatcaagatacacatctaccggatgcccgtcaaggatcttgagaaaatcgactatgagtacgggaagtacacacgcgacctcagacaaaaaaacaggaagacgatatccttttaccgctctctgatcggcagctttgagaagctcaccatcgtgcccaagggatacgagaagtacgagtatagatcaattaaactcgaccagagtgaggagtcactccaggagaggaaactgctggagaggctgatcttcgacggccttagggacagcaataggaaccactttatgagcaccgagcagagcatcatcgagaaagagcccatcaagtccctgagcaagtgcaaaatccaccggggtatctacatagacatcaccgtgaaagagaaaggcgacatcttcatcggtttcgagctgaagcactccatccagagcacccacacgattatcaaggctctgaaggagaagaaactgaacaagggcgataaggtgtttgactttctgaacagcgcccactacgagttcgaggggattagcgacaaaaccatcagcgacccccttcccgaactgggcaacaagagcattatccagcactacaaaacgaaacccagcatctactgccacctcgtgaaaaaaccgaacatgcccgccatcctggtacgcagcaagagcggcaaggtgtatccttaccccccacagctgcttaagaaggagtgcctgatgaaggatgtgccggctaaggagcacagctctatcaagctgaaccccaacgataagatcaactacagcattgagatcatgaagagaatcatagatgcgttcgagaacaggtatttccccatcggctttgaaaagaacaacctgaacatcgccaagctcggatacaggaggaggctggtcccggatcccctgctgaggattggcaacggagccacctgcaaccacagagacctcaagggtgccttccttaggcacaagatttatgacagcgtgagctcccctatctactaccagcttctgcttgaccaacccttcgaaagggagtggcagaaaaagatgagcgaagcgttcattacgaagatggaaaaccggagcaggcagtggggcataaagcttcagtgtaccgggaaccagatcctccctacctctaacccgtacgcgctgagactgcatcttaaggacatcaacctggataccgacatcattagcgtggtcctgttggacgagaccaaacaagaaggcgaggaggtttactctaccatcaaaaaagagctgggtggcaccaggggcgcacatacccaggtaatcctgatcgatagcctgaagaacgaatacactatcccccagatactgttgggaatctacaccaaggctggattgcagccctgggtcttgcaccagccgttgcacgccgactgctacgttggctacgacgtgagccatgaaaatggcaggcacaccactggcatagtgcaagtgttcggcaaagacgggtcacagatcttcagtcagcccattagcagcgcggaggccggagagaaggtgtcaaaggagaccattcagactatggtgatacacgttctttactattaccagaagaaagttggcaagatgccacagcacattgtcttccacagggacggccgaggatacgtagaggagatagactggattaaagacatattgagtaatagggacctcaccaacggccaaagcatcgctttcgattacatctcagtgatcaaagagtgtggtcggcgcatggcttactttgacgacataaagaagaagtatgtgaacgtgcccgggattgcctacctggacgacaacgcccaaaaggcctatctttgcagcaccaatccatacgaaaaagtagggatgagcaaacctattaagattgtgaagaagattggcgagatgaccctggagcagatcgtagaagacatctatcacctgagttttatgaatatcgacaccgataggaaggtgaggctgcccgtgactaccaattacgccgataagtcttcaacgtttttctctcgcggctatctgtcatcacaaaagaaaggaattggcttcgtatagtaa

SEQ ID NO: 89 - DNA, 2571 bp, Artificial Sequence
  Description of Artificial Sequence: Synthetic polynucleotide
atgccgaaaaagaaaaggaaagtggaggaccccaaaaaaaagcggaaggtcgggagtggctccgtggccgctttgaagcgctactttaatgacaagaacctgatcgtgataggctactctggcagggacaagagcctgatgagtgcgcttaccgaggctttctctgagaagggctctggccgcatctactggtgcggctacggcagccacatttcccccgaggtggaaagcttgttgaggaccgcgcgagaggcaaaccgcgacgcctactatatcgacaccgatgggttcgacaaaaccatgttcagcctggtaataaactgcttccaggcggatatcgaaaagaagaaagagataatgagcatcctggagtctgctcccgaggacaacgataccagcccgttctcaattcacatcaccaggacggataaataccttaagtccaacctctacccgatcatctttcctaaggagctgtttcagtttgagatagaatatcatgagggcgaacgaccatggaccctgctgagagagatcaccaaagaccagaacatcatcgccgtgccctacaagcaaaaagtctacgccttgtcaacgggatcagctatcaacaacgtgtttggtagccggttgaaatcagatatagagaggattcccgtgtctatggatgacattgagcgcaagtctagttacagggagctcttcctgagggccacccttcagtctatagccattataaggggcctgaacgtggacatacgacacaataccctttggcggagcgacatctttaggaacgacaatggcaccctcatccacgaagcgatcgagtgttccctggtgtttgtgccccaacagaagtatgccctgttgagcttgaggcccaccatctacatagagaactctcatacggttagcaaggagaaaaagcaggagtacgccaggatctacctggataagatgtggaataaagcgtacagcacgaagttggcccagtgggaatctataatctttggagacacgaggctcgccttcgaggtgccgcaaaattcaggatccgggtttaagtttctgataagccacaactgcggcttcagcgaaatccagtatcaagacaacaccgaaaggggatacagtagcaagagctacgacaacaagaggacgatctataggggcttgcagctgaaggaacccgagctggaatttgtcaatacgtttgcagaccggcccttcctggacagcaaccccatgcgaggcctgagcaatcacaggccgtacgacagctggcagaaagacgttctcttgcagaacgtgcggttgggcgtgatttgcccgaacacgcacaccgaccgattccactcttttctgcagcagcttaacaccacaattcaagccaatgacgatagcgactacattcagtcctacaccggtttccatagcatttacaagactctgctggaaatccccgataacgggaccgacaaatggataaacatcgaggatacccccaaggacaccatcagtctggttcagagtatatgtcaccaagcgaaccgactggccgacaagtacccgggcatcgtggtggtgattttcatccccgcattttggtctatccatcgacagttcaaacacaacggggagagcttcgatttgcacaactacatcaaggcctacgccgcacaacatagcttcactacccaaatcattgaggaaaagacgctgcgcgaccacatggtctgcgaaatttgttggtggctgtcactcgcactgttcgttaaggctatgcgaatcccgtgggcactggccaatttggactctgacaccgcttacgcgggtatagggtactcagtgaagaccaacagcaaaggcaacgtcgacatagtgcttggatgttcacatatatacaacgcaaagggccagggtctcagatacaaactctctaaggtcgagcagccccaattcgatggcaagaaaaatccttaccttacgtatgaagaggccttcaagtttggaattaccatacgcgagttgttcgtcaaaagtatggaccggcttcccaggagggttgtgattcacaagcggacgccgttcaaaaaggaggaaatagagggaatcactcacgcgttgactcaggctggcattaaggacatcgatctcattacgatcaattacgagtacgacgccaagttcatagcgcagaaggtatactatgacaacatcagcgacgattcatatcccgtaagtaggggcacctgcatcaaattgtccagccgaaatgcgctgctgtggacacacggcgtggttccctcaatccgggagagacgacgctactaccccggtgggcgctgtattcccgcacccctgaagataacaaaatactacggtaaaggcgatcttccgacaatcgccagcgagattattggatttactaagatgaattggaacagttttaatctgtacacgaaactgcccgccaccatagatacgagcaatacattggcgcaggtcggcaatctgttgcatcagtataacggcgcaacttacgactaccgatatttcatctagtaa

SEQ ID NO: 90 - DNA, 2376 bp, Artificial Sequence
  Description of Artificial Sequence: Synthetic polynucleotide
atgcccaagaaaaaaagaaaggtggaagaccctaagaagaagcgcaaagtgggatccggctctatgttggagacgaatatcagggtggtgcggcctggtccgcagctgtgcgttcctgtacgcagggtgatcgtgtccggtcaaaccttggctcccgacctcctggagaggctgtgtaacctgctgcgaaggaggtacggcattagcgccgcaagaataccgggctccgtgagcgagctgttcgttgcgaccgaccggcaggtggagaaggtgacactggaagaagataactggcaactgaccgccgtggactccaacgaccctactcgaatcatgtccatctctaacacggacgatgagagctttataagcatcctgatcgaacgcgcgctccttgcccagatcgccagtcgaagcctcttttggaccctcgactctcctcgaatttggtatgagaagaacccgttccaaaggaatgaaggcgtagccgtctaccacaggtacgaggtggatgcgctccccctcggcgacgcaggcattggcatctcagtggatgtttcaacggccttttttagcgagcacaccctggagtactacttcgcccccaacctgattagcggcgagagcaagacgcgacaggacgaattccacaagttcaccggccgacaagctggtcaaaaggggacgctgctttacaataacggcaggagtaaggtgaagtgctatttcgagaacaatagggtgggcctgacatgtggcgcaaccggccaaatgaaactcgagggaatcacgtatcccagcctgtaccactactatgcgagcaagtatagcgcattgcagatcaacgagaacgatgccgcagtgcaagtgtctttccctggcttggaccgcccagttccggtagccgccaggctcctgtccctccgagtgatgaacgacgacgtgcccgatggtctgagctccgtcgacaagatccctccaaggaaccgcaagtaccttatcgagcagttttggaagtgcctggagccgagacccttcgggaatgtggcccctggtgtcttcgacggcttctggagacccaacaacgaaagggtgcattacatccagctgcccgagattaactttggacaaggccaaaaagcagaaccgcctgacgtacgctccgttgcatccatcaaaaactattttaggcgacgactggaattgctgggtcacgcggggtgttaccactttccgccctcagcccccaggacaatcttctgcgcctacccgcagtcattgggtgaggagatcccggaaaagttggtgaacgggatcgtcaatgtgctgaacaagtggaccggcctcagcttctgtagcaacctggtaagctacagcacggccagcgaggcgtacggtaaattgaggagggccgagagtgccggcgtggtcctgttcatcttggacgaggagccggcagtctactacgacgcgagcttcaatcttgagggctggagggtaaagcgcgtaaccgagcctgtgctgcgccagcagcataagtatctgaccaacggcgtgtgggaccggaagaggcaagagtatagtttggggagggggcagagtcgctgggaaagcttcatcaatttgatcggattggacgttatccagcaactcgatgccattccgtataggatccccaacatcggcccctacgaaggccagctgataatcgacgtggggcatgacaggcaattcttcgccgtgtcactgcttattgtgagatcagaagacaaagtgcccgcatttaacatcagcagccaggtccagcacaaggcggatcataagcacgaaagcattaacccggtgctgttgaaggacaccatcattaacgtgttcaagaccgccaaacggaggacttttgatcctctgactagcctgttgatcatgcgggatggcaacgtgcagggcagcgagatcggcgggatagacaacgccctggtcgaacttaggcaacttggcataatctcccccgatgcgaggctggacatcgtgggcgtacacaaggaatctgtaagctccatcaggctctgggacgttgacgtaaggggggaggtaagcaacccgatcgagggcaccggtctgtcagtcaactcatctctgtacctggtggcgtgcacaggtgaggccacgctgacccaaggcaccgcagagcccgtggccatcgtcgcaaacaacaggtgcctgagtattgccgatgcagccctgagcgcctttctggcagcccaactgaactggagcagcccgggagtcgcccagcgcctgcccctgcctctgaaaagaacagatgaggaacttaccgctaggagcgatcaagaaattaggaggataaggtagtaa

SEQ ID NO: 91 - DNA, 2493 bp, Artificial Sequence
  Description of Artificial Sequence: Synthetic polynucleotide
atgccaaagaagaaacgaaaagtggaagatcccaagaaaaaaaggaaagttggtagcggcagtatgataatgagcctggagagcaatatcttcacttttagcaacctcgggacacttaccacgcagtaccgactgtatgagatcagaggcctgcagaaaaggcaccaagagtactaccagaacaggcaaatcctgatccaccgactctcctaccttctgaaaaatgccgtaactatcatagagcgcgacgagaaactgtaccttgttgtagctgccgatgccccggaaccacccaatagttatcccatcgttaggggcgtcatctacttcaagcccaccggccagattctgaccctggactacagcctccgaacaccccagaacgaagagatctgccagaggttcctccatttcatggtacaaagtgccctgtttcaaaacgcgaatttgtggcaacccagcgccggaaaggctttcttcgagaaaaagccctcattcgagttcggatcaattctgttgtttcagggatttagcgttaggcccatattcaccaaggacaagatcggcctgtgtgtagacatccaccataaattcgtcagcaaagaacccctccctagctacctgaacttcaacgagttccaaaaatacagaggcgtgtcatgcatctaccatttcggccaccagtggtacgagatccaactctctgaactctccgagcttaacgcgacggaggcaatggtacccatcgagaataagttcgtgacccttattaactacatcacccagcaagccaggaagcccatcccggaagagctggcaaacgtgtcacaggacgcagccgtcgtgcactactttaacaatcagaaccaggacaggatggcggtgacgagtctgtgctatcaggtttacgacaactcttatccagaaatccgaaagtaccaccagcacaccattctgaagccacacatccgccgcagcgcgatccacggaatagtgcagaagtatctcgcggagctcaggttcggcgacataaccctgaaggtatcaactatccccgagctggtgccccaggagatgttcaacctgcccgactattgcttcggcaacgattacaaactgagcgtgaaaggaagcgagggcacagcccagattagcctcgaccaggtcgggaagcagcgccttgagctgctgagtaaggctgaagctggtatctacgtgcaggaaaagttcgaccgccaatacattctcctgccccaaaccgtgggggacagcttcgggagccggttcatcgacgacctcaagaagaccgtggacaagctgtaccccgctggaggagggtacgacccgaagatcatttactaccccgaccgaggtctccggacctacatcgagcagggtagggctatactgaaaacagttgaagagaacgagctgcagcccggctacggtatcgtaatgcttcatgacagtccggatcgactgctcagacaacacgacaaactcgcagctctggtcattagggagctgaaggactacgatctgtacgtggccgtcatccacagcaagaccgggagggagtgctatgagttgagatataacaaccagggcgagcccttctatgcagtaatacatgaaaaacgggggaagctctacggctacatgagaggggtggcgctcaataaggtgcttctcaccaacgagaggtggccctttgtgctttctacccccctgaatgcggacgtggtgatcggaatcgacgtcaagcaccacaccgccggttacatagtcgtcaacaagaacgggagcaggatctggactctgcccacgatcacgagcaagcagaaggagaggctgcccagtatccaaataaaggcgagcttgatcgagatcatcactaaggaggccgagcaaacagtagatcagctgcacaacatagtgatacatagggacggacgaatacacgaaagcgagatcgagggcgccaagcaggcgatggccgagttgattagcaggtgtacgctgcctgtgaacgccacactcacgatcctggaagtggcgaagagcagccccgttagctttaggctgtttgatgtctccaataccaattctaaggacccgtttgtgcaaaacccacaagtcgggtgctactacattgccaacagcactgacgcctacctgtgtagcacggggagggcgtttctcaagtttggcaccgtgaaccccctgcacataaggtatgtggaaggtacgctcccccttaaactgtgtttggaagacgtgtactatctgacagccctgccttggacgaaacccgacgggtgcatcaggtaccccattaccgtaaagatcaacgacaggaggcttggggaggacgccagtgagtacgacgaagacgccctgcgcttcgagctgttcgagtctctcgagtccgaggatgactttgacgagatgaccgacagcgactttaatcaggaggagacaatggtgtagtaa

SEQ ID NO: 92 - DNA, 3111 bp, Artificial Sequence
  Description of Artificial Sequence: Synthetic polynucleotide
atgcctaagaaaaaaagaaaagtcgaggatcccaagaagaagcggaaggtggggtccgggtctatgctcacacaagaacaatttatacgcaactttagcgttatggccaatggtgaagtagacttctttcttggtgccggtgcatctattgcgagtggaatcccaactgggggtggcttgatttgggaatttaagaggacactgtactgtagcgagtgcggcatcagcgccgaaaagtacaaggacctgtcactcccaagcacgcgcaaaacgctccaggactacttcgacattaaagggtattgccccaaacaatatgcgcctgaggaatacagcttctatttcgagcaatgttacaccgatcccatggcccgaaagaggttcatcgagaatatggttagtgggagggagccaagtataggttacctttgtctcgcggaggccgttatgcaaggcaaagttaaaaacatttggactaccaacttcgatagccttctggagaatgccctccataggctttaccccatgaacaacgttttggtgtgctccgaggctaatagaggcagtgtgtgcctgctcaacccgacgtacccagtcataggcaagctccacggcgactatcgctatgattggctcaggaacaccgaggacgaattgcagcgactcgagaccagccttaaaggttacgcgtccagccaacttacagggaaacaactcgtcgttataggatatagcgggaacgatgagagcattatcagtttcctcaaggattgcatagataacccggcactgcttaccaagggtctgctgtgggctgtacgacgcggttcctgggtaaacccgagggttaatgagctgatagaacgggcgcacaaaattgggaaaccagccgacgtgatcgagatcgatggcttcgaccaattgatgttctcaatataccagatccagaactaccataatgagattatcgacggccaaggcaggctcctccaggtcggatctgacatccgcctcacggggaagcccgtggacagctttgtcaagctgaacgcttacaaggctgagtactgccccctttgtaacgtgttcgagacagacatcacatcctggaaggaacttcggaccataaccggcagcagtgacatcatcgccggtctgttctccaaacatatctattctctgtcttccgcagacaaattgaagaccgtgttcagcaagcactttctctctagcattaacaaggaggaggctcccgaacgggacattcgacggaacgagagtgtgtacattggattgatttaccagcttattaagcggaccctgctttcaaaagggatggtgtccttcgctaagaataaggtctataaccccgacagctgccgcagcgagcaaggctaccaagtttttgacgccctggagatcgcggtcagcttcgttgatggaaacctgtacctgaatcttatgcccacggtacatgtgagaggctcaaatggcgagagtctcgacaaagagtcctaccaaatacaagtcaaccatgtggtcagcacaatctacaataagcaatacaatgagaaactgcggttctgggagagcttgtgtctggacagtggtagaataatcttcgagaacgacggcttcagcatatcatttgtcgctcccgctgtctccctgggcggcaacaatcgaagagctaagtggctttccatgccgtcctgcaagtatgacgaaccactcatgtgcttctcagacactgacaaaagcaaacgagttattaaccaactgaagggactctgccagtacgggccaatcgactgctcttatatgcgggatagcaccacaaggcccagcgttaggctggccgttctgagcccgaaccaggacatggaccgaattcttgcacacctcaataaactcaacacccacgtccaaaacaggggcagcgataatttcctgccccactatgagggctttgagcaagtttacagaagggctctgagcgtccctacgaaggagcagagcaacatctgcatcggatacaacgtgaacgccatcctcaaaatgtctcctgcagagtttctggcttttatgaagcggggtatagagaaatactcccttcggtcaagcgatttcgatatactcgttatttacatcccagagtcattcgcgcatttccggacagcaaccgaaattagtagcgactacaatctgcacgatgcgctcaaactgtatgccacggataaggggattatccttcaactcatagaggagaaatctgtgaagtcatacgacccctgcaaagtaatgtggggcttgtccacctcactctacgcgaaggcgacaggggtactttggcatccagaggcaattagaaatgacacggcctacatagggataagctacgctttcagcgaagagaaaaggatttgtataggctgcagtcagctgttcgactcaaccgggacaggtattcggatggtccttagaaagataaacaatccgatatttctggggcgatccaacccctacatgagggaagacgacgctcgaattatgatgaccgagctcagggagcagtattaccacagcgcacctgtgaatactctcaagagggtcgtgatccataagaccacgcccttcatacgggatgagatagccggtataatgcaggcatttaacggcatcgaggtcgagctggttcagattcaagactattgctcttggagaggcatacgcttcggcggtgagcctgggaaaacggcgtttgggttcccggtgaagcgaggtatggccgtaaaactcgaccgagaaagcttcctgctctggacccacggctgcgtgattcacccggaactgtcaggcacgcataactatttcaaaggttcacgcggtatcccagcacccctcctggtccgcaggtttgcgggtaacgcaagtggcgacacattggcaaaagagattctgatgcttacgaagatgaactggaactccggtgacagtctgtacaaaacccttcccgtgaccctggattttgcgaaagttctcgcccgcatgtctaagcaagatgaggcgatctttgataaggcgtacgacttcaggtttttcatgtagtaa

SEQ ID NO: 93 - DNA, 2316 bp, Artificial Sequence
  Description of Artificial Sequence: Synthetic polynucleotide
atgccgaaaaagaagcggaaggttgaagatccaaagaagaagaggaaggtggggtctgggtcaatgctccttaatcatctcccaatcgagttctccagcgcacagttcgctggacacgaaattgcttatgtcgacggcgagcagttgaggtccatacgacagagactcacgcgcacgcacttcgtgttgagggatggggacaatgttctgctcttcccgtacgaacatggaaccgcgaccgagggaaccaggcgaacattcgacacgggcgttaatttcagcgtagccaacgccctggcgcgcaacggcatgcttctgcgattcttccagcactctagaagtatttccggcgtccgaccggtgaaatttgtgaaagacaaccagaacctgctcacgggtgacgtaggccggttgtttgctatatgtccggagtacagtttcgacatccgacccctggcacctcaagacggcagccttgtgaacggggtactggtaaacttctcagcccgatttttggtgaagccctccctcgacgaattgattgcgcaggggctcgacccacggggcctgtatgttgttaaagaggcagaaagagaatcaccctacatcctgccgatgtttaatcggagattggtagggcggatccaggacgtggtcggaggtatcgccaagctggtggacgagcgcgaacaggacctccctgtacatgaacttcatgtcgaggccaacctggtcaacttcgagaaagtaggcagagcactgcttggccgggattacgagcgagtgagtcgacaagtgcttcccaccctccataaggtgagcggcgcagagaaacagctcgatcgcttggtccagctgctgacgagcttcaaagacctccagggtgacatcccgtgttgcgacggcctgaccgttagactggcaggcatacttacagatgtgcccttcggcagtgaggtgggccaattccgcaaattgtccgcgccacagtgcagcctccgcccagggggaactattacggtgccgtggcccgtggacggcaaactcaatgccaacggcccctttgatgcagacgccttcagcaggaaggaaccaacaatcggcgttctgtttccggagcagcacaagggtagtgtagaagagctggccgctaaactcagagacggcgcaccgagcgatggaaagtacccaagtccatttccccaaggaatgccccggaagtatagacttaggaagatgacatatgagctgacgcccacgaaagtttcaggggacagggccgcagcctacaagaatgccgcgcttgcagccgcccaacaagagcttgatctcgctctggtggtcatatctgaatcagataaggcgttgcttggagccgccagcccctactacactgcgaaagccacattgatgagccaaggcgtgccggtgcaggctattaccattgagactatcaacaggctcaacccctacaccttgaataatctggcactttccctttacgcaaaactcggcgggataccttggaccctgtcagttcaacagcgactggtccacgagataattgtagggatagggtctgcgagagtgggcttcgaccgcctctcagagcgggagaggcttgtcggcatcacgaccgtgttctccggggacggatcataccttcttggcaatgcaacgacggaagccagcagtaccgaatataggtctcgccttctggagagccttagggcgactttggcagagttgcgaagacgatttggctggcagcggggagataaattgaggattatcttccaccaaagctataagcggtacaaggagaccgaagcaaccgccgttagcgacctcatcgccgaacttgatgaattcgatgtggaattcgcgtttgtgcagatcagtagcgatcatgactggaagttgttcgatgagagtgccacaggcgttacgtatcagtcccggcaaaagggagcgaaggtgccggaacgcggagtcatagtccctctcggacctcgcgctgcgctgatcacgttggtgggtccgcatcaactgaaaaccgacctgcaagggtgcccctcccccatactggtgtctatccacccgagctcaactttcaaggatttgagttacgtgtcaaagcaggtgttcgacttgacctttatgagttggcgaagctttaacccaagcacgcagcccgtttccgtgagttatcccaacatggtggtggatctgctcggtaacctgcggcaaatccccaacttcaatcccgacattctgacgacaaaactgagggagtctaggtggtttctgtagtaa

SEQ ID NO: 94 - DNA, 2970 bp, Artificial Sequence
  Description of Artificial Sequence: Synthetic polynucleotide
atgcctaagaagaagcgaaaagttgaagaccccaaaaaaaagcgcaaggtcgggagcggatctatgatgggagccagcgatgagtattccttttacgctgaaaaggcctatcccatagaagcggacaggcaaaagtacttcgaacagctggcgtacaacaaagccccctacattggctataaactcttgtgtctgctgaataacgcggggctgataaagtctgtttggaccacaaattttgatggcctgacggaaagggccgctcaccaaatgaacatcacccccatctgcattaccctggacgaccccgagaggatttttaggaatgagaactctcacgaactgctgtatatcgcccttcacggcgattacaaatatagcaagctcaaaaataccacccacgagctggacacccaaaacaatatcttcagagacgcactgaagcgatacttcgtggataagaatcttattgtcataggatacagcggccgagataaaagcctgatgaacgcacttaaagaggcattttcccaatccggctccgggcgactgtactggtgtggcttcggggacgatatatgcagcgacgttaaggaattgatagacatcgccaggagcaataatcggattgcctacttcatcccgacggacggcttcgataagaccatgctccaacttagtcgcgcctgtttcgaggacgacattgtgaagcaggaggaaatcaaaaagctgatcaagtccacgatcaagaaggacgagacgaagaccagcttccgaatcgagagcagcaggaacgataaacttattaagtctaacctgcatcccgtggcgttccccaaggacgtgtaccagttcgagattaagactaacggcgagcatctgtggaacaacatagaccagatcattggcggcaataaggacatagttgccgtaccgttcaaaggtaaggtgttcgctgtctcaagcattgcgaaaatcaaggagaggttcgggggctatatcaagggggaaatattgaaagacccgattggcgtcgatgacatccgcaaagtatctgtgttccagcggcttatgatgaagagcatcctgattggaatctctgagttggcaaatctggaaactgatggaaagtggcgcctttggaaaaagaacaccctgaggcgaatcgtaaacggcacggagtatttcatcgccgacgctgtagagctgtcctttttcttcggaaaagataccaagtttgcctatctcagcatcaaaccgaccatttacatttatacacatagcgacgaattcataccgaaggatataaagctgcaattcacaaaggagaagttcgaccgactctataatgcacaatacgaccaatccctggaggagtggaataatctcatcttccacaacaacagcctgaggttcacctttcccgtactgaccacctccgacatgagctttagcatcagcaacaatgtggccttctcaggaattaaggttttgagtgacaagtataagagctaccccgtttctatcgagcagaagcgcatagttttcaagggcgtggagttcctggagccccagctgctgtttcaaaataagaacagcaacttcaagtcacgcgacttccatcccatgaggggattgattaaccactaccccttcgactaccagaacaatgggatcaccaacacgtttaatgtcaaactcggcgtgttgtgctcctctaagtactctactaggctgtacgagtttctcatgaaattgaatgcccaacataaagcgcccgagaaaaacgagtacataattgactatgctggattcaaccaaatctacaacatccctattgagataccgctggtaaacgacgagaagtggatggacgtaaagtttaatagcagcgtgagtatcaaagacgacgctctcaacctggcaagaatcatatgcacccagatcgaggcgcttcacgagtcttacaaaactgacatgaccatcgtgatcttcattcccaacgagtggcaaccctacagacatatcgaggaggacacatgggtttttgacctccacgactacatcaaagcatatagcgctcagaaaagaatttccacgcagttcatagaggaagatactctgaacgattcattgacgtgccagatatattggtggctcagccttagtttttacgtgaaatccttgcggacgccgtgggttctgaatgctaacaataatgagaccgcttacgcgggcatcggctacagtataaagaataacaacggtgaggcgtcaattgtcctcgggtgtagccatatttacgacagccacggccagggcctcaagtacaaattgagcagagtgcaggactgctacatcgacaacaagcggaacccctacctgagctacaatgaggcctacaactttggcataagtatcagggagctctttctgcacagcatggagtacctgccaaaaagggtagtagtgcataaacgcaccgagttcaaacccgacgaagtgaatggcattgtcgactcactgcagatagcgggtatcgagaatatagaccttatctccatcaacttcgagcgggaagttaaattcatgtccactaaatccaactacgggcagttgcaaatcgataactttcccatacgcaggggcacctgtatcgtggtgaacgactatgaagcccttctctggacccatggaattgtgccgagcgttaagtccgataacaggaccttctatctgggcggacgatctattcctagccctcttatcattaagaagcattacggtaagagcgatatcaacgttatcgctacagagatactgggtcttaccaagatgaattggaactcttttgatctctacacgaagctgccggccaccatcgatagctctaatcaaatcgcgcggatcgggaacctgctgactaggttcgagggcaagacctatgattaccggtttttcatttagtaa

SEQ ID NO: 95 - DNA, 2259 bp, Artificial Sequence
  Description of Artificial Sequence: Synthetic polynucleotide
atgcccaagaaaaagaggaaggtcgaagatcctaaaaagaaaaggaaagtcgggtccggtagcatgcccacccagttccaggaggtggaagtgatactcaaccgcttctttgtaaagaaactgtctcggcccgaccttacgttccatgagtaccaatgccagttcacccaggttccagagcaaggcagcgaacaaaaggccatcagcagcgtgtgctacaagctcggtgtgaccgccgtgaggctgggctcatgcatcatcaccagggagcccatagaccctgaaaggatgcgcaccaaagattggcagttgcagctgatcggatgccgagagctgagctgccaaaactaccgagagaggcaagctttggagactttcgagcgaaaaatcctggaggaaaagctcaaggaaacatttaagaagaccatcatcgagaaggactacgagttgggcctgatctggtggatatcaggcgaagagggactggaaaaaaccggtcacgggtgggaagtgcacaggggcaggcaaatagacctcaagatcgagacggacgaaaagttgtacctggagatcgacatacatcacaggttctacacccccttcaagctggagtggtggctgagcgaataccccaacatccaaatcaagtacgtgcgcaacacgtacaaggacaagaagaaatggatactggagaatttcgccgacaagagccccaacgagattcagatagaggcccttggcatcagccttgcggaataccaccggcaagaaggtgctacccagcaggaaatcgacgagagtagggttgtgatcgtcaaaaagatctctgactacaaggcgaaacccgtgtatcacctgtctcagaggctgtccccgatactgaccatggagacccttgcccagatcgccgagcagggtcgggaaaagaaggagatacagggcgtgttcgattacattaggaagaacatcggcacgaggctgcaggagagccagaagatcgcgcaggtcattttcaagaatgtttataaccttagcagccagcccgagatcatgaaggtgaacggttttgtaatgccacgcgcgaagttgttggcaaggaacaataaggaggtcaaccagaccgctaggatcaagagtttcggctgcgctaagatcggagaaacgaagttcggatgtctcaatctgttcgacaacaaaccggagtacccggaggaggtacacaagtgcttgctggcgattgcgcggagcagtggggtccagataaagatagatagctacttcacggggagcgactacccgaaagatgacttggcccagcaaaggttctggcaacagtgggcggcacaaggaataaagacggtgctggtcgtgatgccctggtcccctcacgaggagaagacaagactgcggatccaagctcttaaagccggcatcgcaactcaatttatgatccccacgccccaggataacccatacaaagcattgaacgttgctttgggtctgctctgcaaagccaaatggcaacccgtttacctgaagcccctggatgacccccaggccgcagacctgatcatcggcttcgacacttctaccaacaggcggctctactacggtacaagcgccttcgcgattctggcgaacggccagtcactgggctgggagttgcctgacatccagaggggcgagacatttagcggccaaagtatatggcaggtagtgagcaaacttgtgctgaaattccaagacaactacgacagctaccctaagaaaattctgcttatgagggatggactggttcaagacggcgagtttgaacagaccataagagagttgacccaccaagggatcgacgtggacatcctgagcgtgaggaagagcggtagtggcaggatgggaagagaactgacaagcggcaatactgccatcacctatgacgacgccgaagtgggaaccgtgatattctattctgccaccgactcattcatactgcagacaaccgaggtaattaagacaaaaacgggcccactcggttccgcgcgaccgctcagagtggttaggcactacgggaacaccccgcttgaactgctcgcgctgcaaacgtaccacctgacccaattgcatcccgccagcggctttcggagctgtaggctcccctgggttctgcacttggcagacaggagcagcaaggagttccaacggatcggtcaaatttcattgctccagaacgtggatagggagaagctgattgcagtgtagtaa

SEQ ID NO: 96 - DNA, 3120 bp, Artificial Sequence
  Description of Artificial Sequence: Synthetic polynucleotide
atgccaaagaagaagagaaaggttgaggatcccaagaaaaagcggaaggtcggcagtggcagcctgggagccggtgccagcatcagttccggcatccaaagcgctaatgactgcatttgggactggaagtactctatctaccaaactaactccggcagtcaacgagtggccctcgtggaccctaagaaatccgacgcctccaagtctatcatccagaagtggctggataatcaaccgaaattctcacagatcgaagcccatcaggagtacagcttctacgcccaggcggcttaccccattgaggcggaccgaatcaaatactttcagaatctcttccaggggaagtccccctatatcggctacaaattgctctgcctgctgaacaagtacggtgtagtgaaatctgtgtggagtaccaacttcgacggcctggtcgaacgggcagcacagcaagccaacatcaccctgatcgccatcaatcttgactgtgttgaccgcatatatcgagcagaaagcgtgaatgaacttctgtatatcgcgctccacggggactacaagtttagtaccataaagaataccgcgaatgagctcgacagccagcacaccgagttcgtatctgccatgtgccggtacttcgtcgataaaaacttgatcgtcatgggatacagcggacgcgacaagtcacttatggacgccctggtccaagcgtttagcaagaagggtggggggagactttattggtgcggcatgggcgagaccatcacgatcgaggtgcaaaacctgatacagagagtgaggaccgcaggccggtcagcttattatgtagatacctctgggtttgacaacaccatgctgtcactggtaaagtactgtttttcagaggacgtcgccaaacagcgagaaataaacgaaattttgaaaattgtggaaccggagcagattactccgtttgagattcaaaagagccagaacaaacggtatctcaagagcaacctgctgccaatcgtgcttcccaaggaactctttcagtttcagatctcttataacgacacggcggacaggtggggattcttgcgcgagaggattaaggagcgggaaatcatagcagtcccgtaccaggacaaagtatacgcaatcagcacggtctccatcattaacgacgttttcaaggactgtctcgtaagcgagattgagcgcacgtccatctctctgaatgagatcgagcgcaatggctgcttcaaagagctgttcctcaaggctattctctacgggtttagccaaatccggaatctgggcatcaactaccgccacggcatcatttggaagaaggaggcgctctacactgagcccggcaagaccgtacacgaggccatagaatgcggcttgtcttttataccgcaagcgaactacgctttgattagcatcacaccaagtttgcacatcgaatccagcagcccgatcgaaaaagagaagaaacaagagtataacaggcggtaccttgacaagatgaggaataaagagtacgaggaaaagatccaggagtggtgcaacatactgttctccggtaacaagctcgtttttgacatcccgctgcaaagcaacaacgacttgaagttcttcatttccagtaataggggtttcgccgaggtatacaattacggtaaggacatcgagaagagctacacgcccaatgcttacaatacgaaacagaccatttactacggcatgcaaatcgaagagcctcagttggagtttatcaactccataatcagtaggccgttctatgacgttaacccaatgaggggcctctcaaatcacaaaccattcgacgcggactactatgacaagttcccccaggatgtgtgtttgggcattgtgtgtccgaccagctacagcctgatgttctcagaattcctgaagcgcctgaacactaagatcccagcaccgaagtcatccgactacatccacaactatattggctttaacagcatctacaactgcaggctggacataccggacatcaatgccgatcgctgggtgagcatcggcgacaacccccagaacgcggaggaattggcccgcaacatctgtatggaagcaaaaaagctgagtgaacaatatccgggcatcgtggttaacatattcatccctactatctggagcaactacagaaactttaaacacaacggtgaattcttcgacctgcataactacattaaagcatttgcggcacaaaatcgcttcaccacgcaactcatcgaggagaaaactgtttgtaacacgatgatgtgcgagatatcctggtggctttcccttgcccttttcgttaagaccctgaggactccgtggacactggctgaccttaaccccaacaccgcctacgcggggatagggtattcagttaaaaagcaggccaagggcaggacagagatcgtactggggtgtagccacatttacaatgcgcagggacagggactcaagtacaaactgagcaaggtcgagcacccacagttcgacaaaaaacggaacccattcttgagcttcgaggaagccttcaaattcgggatggatattcttaatttgttccagagtgcaatggaaaaactgccgcagagggtggttattcataaacggacgccttttagggaagaggaaatagaagggattaccagcgccctcaagcgggcagggatcacggaggtggacctgatcactataacgcaggagcgaaacattaagtttatagcacaggttgtctccttcggccaactcaataccgacggctatcccgtcaacagaggcacttgcatcaagcttagctctcgcaatgcactcctttggacccacggcgtcgtccagagcattcgagacaaaagacggtactaccaggggggcaggtgcattccgagcccgctgaaaatcactaagtattacggcaacggcgatctccagactatagctaaggagatcatcggtttcacgaagatgaattggaatagcttcaacttctatacgaagctgccagcgaccattgacactagcaacaccctggcccaagtgggcaaccttctcaggaactataatggcaccacctacgattatcgctactttatctagtaa

SEQ ID NO: 97 - DNA, 2367 bp, Artificial Sequence
  Description of Artificial Sequence: Synthetic polynucleotide
atgcctaagaagaagaggaaggtggaggacccaaaaaagaaacgaaaggtggggtctggctctatgccacacacctccctgctgttgaactttctgcccgtctctcttagcggcgacacacgcatccatgtcggctaccggccatataacgaggatgtgctgcgggaactgagggaggagttcggcgaaagccacgtgtttaaaagggactaccaggaggacacgataagcgagataccggtcatccccggagccgagccccttagcgacaaatctactggcgtggatcttgccgaagcgcgatggctgtggaaaccacttctgaacgctgcattgcttcgcctcttcagcggaagcagagagatcacctctgattatccagtcagcgtgcttggtaaccccaagaacaacttcatcagccatgccaatctccccgactgggtgagaatcctgccccttctggaattcgagagccgaaccctgttcggtggtaaatccggtccgcagtttgggcttgtttgcaacgcccgaactaggcaccaggtcctggcaggctgcgaccatctcattgaaagaggtataagtcccattggccgctatgttcagatcgaccagccacaaagagactccagacttgcgccacgcggtctgactgttggtaaggtgagctctatcgatggggacacgttgatcctggaggatcaccgaaagggctacgagcgcgtgaaggcaagcgacgctcgccttaccggcaatcgggcggacttcgactggtgcgtgaacgcgctgttgcctggacaaggtcaagcaacgctgagcagggcgtgggacgccatgagcgccctgaatcagggacccggccgcttgcaaatgatcaatcagacagctgaatatctgaggaccgtgaaccttgaggcggttcctggggtagcatttgagatcggcgagtggctgagttctaccgatgctcagtttcctgtgaccgagaccatcgaccgccctaccctcgtgtttcatccctccggccgacccaacgacacttggaacgagagggggataaaggacaatggcccgcacgaccagaggacattcacccccaaacagttgaacatcgccgtgatttgccagggcagatttgagggacaggtagacagattcgtgggcaagctgctcgatggcatcccggactttcagttgaggaacggcaggaagccctacgacgacggtttccttagccggtttaggctggagagggccaacgtgcaaacctttcaggctaacagtgcgtcccgcgaggcttacgaagcagcgtgtgaggacgctctgaaacatgccgctgataacggctttggctgggatctggctatcgttcaaatcgaggaggatttcaaggcgctgcctgggccccaaaatccctactacgccaccaaggcaatgctcctccggaacaacgtagccgtgcagaacatcaggatcgaaacaatgagtgagcctgacaaaagcttggtctacactatgaaccaggtttctcttgcttgctacgcaaagctgggtggtagaccttggctcctcggtgcccaacagagtgtcgcgcatgagttggtgattggactgggcagtcacaccgagcaacaaagcaggtttgatcagtccgtgcgatacgtaggcatcaccaccgtattttccagcgatggaggctaccatctgagcgagcgaaccggagtagtgccctttgaagattacgccaaggagctgacagacaccctcactaggaccatagagagggtgcgaagggaagacaattggaagaacactgatagagttcgcctggtgttccatgcttttaagcagattaaggacatcgaggccgaggccatcaaacaggcagtggaatctcttgatctggagaacgttgtgttcgcattcgtccatgtggccgagcaccacccttatttgatcttcgaccaaaaccaagagggattgccccactgggaaaagaacaggagcaagcgcaaaggcgtcttgggacccagcagaggcgtgcatataaagttggcggacagcgaatcccttgtggtatttgctggtgctagcgagttgaagcaggcggcacacggtatgcctcgggcctgtctgctgaagctgcacagaaacagcaccttcagggatatgacctatctggcgagacaagccttcgatttcaccgcccacagctggagggtgatgacccctgaaccatttccgatcacaataaagtacagcgacttgatagcagagcgattggcgggtctcaaacaaatagagacctgggacgacgatgccgtgaggtttagaaatattggcaaagccccctggtttctgtagtaa

SEQ ID NO: 98 - DNA, 2121 bp, Artificial Sequence
  Description of Artificial Sequence: Synthetic polynucleotide
atgccgaagaagaagcgaaaggtcgaggacccgaaaaagaaaaggaaagtggggagcggcagcatgcagcaggagatccagcttaacatcatccccttcaccgcccctgtggaagaggcagagttcgctttttacaccgccaagcaagacggctactgccccatccataaggatgacctgaacggggccatcgaaggcctcgtggatgaatcagacctgcactacggcaactggctgtacactgacttcgctcccgccaaagagaacgccatcataattagcgtcaatctcaatgactgtaagtacttcgcccagcactactacaggcaccttatcaggacccacttcaagggagtggccgacatcatgaggaagaatttcaccaacgaaatcgaggtctggttccacaataccaaagccagctctaccaagtttaaggtctataaccagtttaccctcaaggtacagcacaacagggtgacggacggaccggaacttgtcgtgtccttcgacgggacgacgaaggtgctgaacaagtctatcgccgagatacacaacttcaaaacggagctttacaactggataaactgcaacggcgagcttaatcgctggaaatacctgaccgacgatcagaagctgaatcacgaaaagaactacccggtagtgtcaaacacacttaaaccgcatttcgacattgcctttgacgttcccgattttaagaaccggtatcccaaatacttcactcttctgaatgacttctacaacaactatctgaatacagacgcctttactgcgatcttgccgctttccgctgacggattcttcaagccaaatggcctgtcagtgcagaggatcaacggcactagcaatgagctgcaattcggcaatggcgtcggcgtggagcccaaaagggatctcaagcgcctgaagccgtataaacccgtgcccaaacccagcaacgtaaagtttttcttcatctatcacaagccagatagggagcatgcggtcaaaaacatctggcagtatttcaaagacggatacaacggccaataccccttccccaagatggaggaatacatatctcagcccttcgagcttgaggagaatggatctatctcattcgacaatatcgacgacgcggtaagcgttgtccaaaaagccatcaagaacaaggatcggctgcccgacactaaatactttgcggtatacatctcccccgtaccaaaatgggagaaggaccctaaacggaatagtatctaccatcggatgaaagagatactcctgtacgaggggatcaccagccaggtgatctggaaggagaacattagcaaaccggctttcaacctcttcttgcctaacatcgaaaccgccatactggccaagctgggaggcgtcccctggaggctcaagagggacaccacgaacgagttgatcgttggcgtgggtgctttctactcaatcacgcggaagtccaagtacgtgggctctgcattttgcttcaataacgagggcatctttaaggggttcgactgtttcggtgccaatgacaccgacagcatcgcgggctctatcagggaggccgtgggaaagttcatcgcgtctaattacaaggccacaaggctgatcattcacttctataaggacctgtcaaagaaggagctcaaaccaatcatcgatacacttcacgccctgggcttgcccatcccagtgatagtcgtgaccatcaataaaaccgagagcaaggaactcctggcatttgataccagctcacaaaagctcatgccctactctggcaccatcgtgaaggtgggagccaaggagtacctgctgttcaacaacacgcgatacgaggaagcatccgccccaacggatcgcgagcaccacttcccggtgaaaatcagctttttctcagacaaggcggagctgttggacgatcccgcactgatcaaccaactgatcgaccaggtgtaccagttcagccgcatgtattggaaaagcgtgagccaacagaacttgcccgtaaccattaagtatcccgagatggtggcggagattttcccatactttacccacgataaattgcccgatcatggaaaggagagcctgtggttcctgtagtaa

SEQ ID NO: 99 - DNA, 2118 bp, Artificial Sequence
  Description of Artificial Sequence: Synthetic polynucleotide
atgcccaagaaaaagcggaaggttgaggacccaaaaaagaagaggaaagttggcagcgggagcatggaaaatctgaccctgaatatcatccctttcagccaccccgtgcaggagcttgagatcggcttctataagcaagagaaacagggatgctacagcctgtggaagggcgagtacccgcagtcattctgggacgacttcaacgaggaaatgcaaaattgcgacaaactctacaccaacttcattgacacggaaaactgtgattacaaagccagtgtggactttagcaaaaacagacgcctggcggtccattactacagcaggctgatctacaactactttgaaacagtggcagatgccgtgaaaatcaacttcgtgaaagatatccagatatggttcaaggacgagaccaagagcaccgccgtctataccagttacaagcggttcacgatcaaggtccagttccataaggtgaccgagtccccagagctgttgatcagcttcgatggcaataccacggcctataacaaaagtctggccgagttggacgatttccctcccgagctgattaactacgttaagtacaatacccaagtggtgaagtacgagttcgccgaggacgctattaagcagcatatcgaggagctgtacccgatcctgagcaaccccatcagggactaccttaagattgccaggcccgattttaagaggggcaacaagtataagccctactacaagaacattacagacttctatcacaaccacctgaactccaaagagtttaaagctatcctgcctatctccgaagacggtttctacaaaatgcctaagcacaaggttcacaaaaccagcttcaatagcaataaactgagatttttcaataacacggacatcgtgccccacaacgggatgaaaaacatcggcccctataaggcgtccccccaccccaacgtgaggttcttcttcatctaccataagccagaccgaaacttcgccgtcaagacgctgtacgaatactttacggaagggtacaagagcccagagggctacctttacttcaagcctctcaaaacctacattaaacagccctttctcatcgacaaggataccagcatcgcgttcgaaagcccggaaagcgctctgcgcgaagtcaagcagggtttgcttaacctggaaaagcagcccaatacgaaatacgtcgctatctatgtgacccccatacataagaccgagaccgacgagcagaggaagatgctttattaccaggtcaaggaagaattgctcaagcacgacatatcaagccaggtgatatacaaggacaacattggacataaggattttagtttctatctgcccaacatcgccatcgccctgctggccaagatcgatggaatcccctggaggctggacagagacactaaggaggaacttatcgtgggcgtaggcgcattcacaagcctgaaccacaatatcaaatatgtagctagcgccttctgctttaacaacaatggggaattcaagggattcgactgcttcaaagcgaatgaaaccgaacttttggctggcaccatcggcaagcaaatcctgaagtatgtggtggacaacggcgagagcgccaagcgcctgataatccacttttacaaaaagatcagtaacaaggaactcgagcccataaagaaaatgctgaacaagctgaacctgaccatccccgtagtgatagtgactatcaacaagacgacctcagaagataacgtggcgtttgacaccagcagccataacctgatgcccgtgagcggcacctacctcaaaataggatgggaccagtacctccttttcaacaacacgagatacaacgccagcgacaccgagaaggataaccccttccctgtaaagctgagcttctctagcaccgtagacaattacttcgacgacaggaaggtggtcgaggaattgatcgaccaggtgtatcagttctcccgcatgtattggaagagcgtgaagcaacagaacctgcccgttaccatcaagtaccccgagatggcggcagagatcttcccattttttgaaggcgataagctgcccgacttcggaaagaataacctttggtttctgtagtaa

SEQ ID NO: 100 - DNA, 2124 bp, Artificial Sequence
  Description of Artificial Sequence: Synthetic polynucleotide
atgcccaagaagaagagaaaggtggaggacccgaagaaaaaacgaaaggttggcagcggcagcgtgcagcagacagtggagctcaccctctacacagaaaaacatcccgacacccacccagagctcgtttatgccgacgagtgtcccgacctgtggcaacagcacagcgagcttacgggggacaaatctctgttctactctcttacgaacccggcagaatgcaagggaacccagtacacagtgcaaatcaacctgaataaccagaagcagcgaaggatcgccaagcacataattagccagcaactgtataatcacttccgccagacccaaatcgctaccttcgacaagatcgacaatgtggaggtgtggaccaagaacacccaacagcctacccagaattgcacggagtacctgaggttcagccttataccccaatacgccgtgttctctgactcatgggagctggtcgtgtcctcaaatggcatatccaccgtgtataacaagcctttgagcgcactggaccttcagaccgaccgattcaaggtcgtcgttggaggggaagtggtcaagtacaagaacctgagccccaatcaaaagcaacaaatagacgaggccttccccaaaatcaatagggaactggccgctgaactgcatattaacgagaaacgctttctcaataaagacaagtatacgaccacctacaaccacattaacaacttcgtgcgacagcaccttctcacatccgagttccaggcactgttttgtctgagcggcgagatgttcaacgtacccgaggagcggatcggccaagtggcgaagggggcgaacctgttgcagtttaaggacggcaagaccggcattgacccattcagctgtgtgttcggcagcaagagcatggacgcactcggcatctaccaacccagcctgaagccccaggtgaaattctttttcatcgcccagcaaagcgatatcaacgtgtgcaaaagcctgtacgatattttcacgaagggatacaagccctacgtggacacagccactggcgagcagaggtacgtgttcccacccctggcgacgtgcatcaagcagcccttttcaaccgaccccaaggggagcatttacttcagcgaccctcaaaatgccctgagcgagatcaagagccagcttaacaataagcctcttgacccccaaacgcagtatgtgagcatatacgtgtcacccatccctcgcgacgccgtcaacaatccctactacggtctgtactttcagattaaggagctgctgctcgaaaagaggataacgtctcaggtgatctataaggaccgccccaacaaccagtacttcaacttccatctgcccaatatcgcgactgccatcctggcaaaaataggcggcatcccgtggcagttgaactcccacacgacgaacaaagatctggtgataggcgtgggcgccttccttagcgaaaaagttggcgagaggtatgtgggcagcgcgttcagctttaaccccaacggcctgtttaagaacttcgactgctgtaaagcgaacgatctcgaatctatcgtagccgggatcagaaaggccatcggacacttcgttgtggacagcgaaacaaacccccagaggctgatcatccactactacaagaccatgtcaaagagggaggccaggcccatcacgcagatgctgaacacgcttggcctcaacattcctgtattgatcgtcacaataaacaagacggagaccagcgacattgttatgtttgatgagaaacagcagggctacatgcccctttcaggcaccgtactgaagataaggaacgatgatttcctgctctacaacaatagcaggtacaaagagaacgaaaagtcagatatgctttttccagtgaggatccgcctgagtaagatcgtaaaccaatccgacaaagacatcccaatgacagacgccttcaatttgctcaaccaagtgtaccagttctcacgcatgtattggaagagcgttaagcagcaaaacctgccgatcacgataaagtatccagagatggtggccgagatagtgccacacttttcagaagccgaattgccgcagttcggaaagaataatctgtggtttctgtagtaa

SEQ ID NO: 101 - DNA, 2310 bp, Artificial Sequence
  Description of Artificial Sequence: Synthetic polynucleotide
atgccaaagaaaaaacggaaggtcgaggatcccaaaaaaaagagaaaagtcggtagcggcagcatgaactacacagccgccaacacggccaacagcccattgtttctcagcgagattagcagccttaccttgaaaaacagctgcctcaactgcttcaaactgaattaccagctgactcgcgaaataggcaataggttcggctggcagttcagtaggaagttccctaacgttgtggtggtgttcgaggacaactgtttctgggttctcgctaaagatgagaagagcttgccctctcctcaacagtggaaggaggctctgagcgacatccaggaagtgctgcgagaggatatcggagaccactactacagcatccactggcttaaagacttccagatcaccgccttggtgaccgcccagctcgccgtgcgaattctgaaaatcttcggtaaattcagctaccccatcgtgttccccaaggacagtgaaattagtgagaatcaagtgcaagtaaggcgagaagtcaacttctgggccgagatcattaacgataccgaccccgccatttgcctcaccatcgaaagcagcatcgtctattccggcgatctcgagcagttctacgaaaatcacccgtacaggcaagacgccgtgaagctgctggtgggcctgaaagttaagaccattgagaccaacggcaccgctaagatcatcaaaatcgctggcactataggggaaaagcgcgaatacctgttgactaaggccacgggaagcatatcccggcgaaagttggaggaagcccacctcgcacaacccgtggttgcggtgcagtttggtaaaaaccctcaggagtacatataccccctggctgccctcaaaccttgcatgaccgacaaggatgagagcctgttccaggtcaattacggcgacctcctgaagaaaaccaagatcttctacgctgaacgacagaaattgcttaaactgtacaagcaggaggcgcagaagactttgaataacttcggttttcagcttcgggaaaggtccatcaatagcagggaaaatccagacttcttctggacgcccccaatttcattggagcagacccccatcctgtttgggaagggtgagcgcggtgaaaagagggagaccctcaagggcctttcaaagggcggagtctacaaaaggcacagggagtacgttgatcctgccaggaaaattaggctggccatccttaaaccggactcttttaaagtgggcgacttcagggagcagctggagaagcgactcaagctgtataagttcgagacgattctcccccctgagaaccaaatcaatttttctgtggagggtgttgggagcgaaaaaagggcccgactggaagaagccgtagaccagttgataggtggcgagatccccgtggacatcgccctcgtctttctgccccaggaggaccggaacgcggacaacaccgaggaaggctccttgtatagctggatcaaaaagaaattcttggatcggggggtgataacacagatgatatatgagaaaactctcaacaataagagcaactacaataacatcctgcaccaggtggttcccggcatattggcaaagctcggaaacctgccgtatgtgctggccgagcctcttgaaatcgccgactacttcatcggcctggacgtcggaaggatgcctaagaagaatctccctggttcactgaacgtgtgcgcgtccgttaggctctacggaaagcaaggtgaattcgtccgatgtagagtcgaagatagcttgaccgagggggaggaaatcccccaaaggattcttgagaattgtctgccgcaggcagaacttaagaaccagaccgtcctgatctacagggacgggaaattccagggtaaggaggtggaaaaccttttggctcgggcacgagccatcaacgccaagttcatcctggtagagtgctacaagaccggcagcccgagactttacaatttcgaacaaaagcagattaatagccccagcaaggggctggcgcttgcattgagcaaccgggaggtcatcctcatcaccagccacgttagcgaacagatcggcgtgcctcggcctctccgcctgaaggtgcacgaactgggagaacaggtgaacctcaagcaacttgtggacacgaccctgaaactgactctgctgcattatggctctctgaaggaacctcggcttccaatccccttgtacggagccgacgccatcgcgtataggaggttgcaaggaatctatccaagcctgctggaggacgactgtcagttctggttgtagtaa

SEQ ID NO: 102 - DNA, 2352 bp, Artificial Sequence
  Description of Artificial Sequence: Synthetic polynucleotide
atgcccaaaaagaagaggaaagttgaggatcccaagaaaaaacgaaaagtgggtagcggtagcgttccaggcggtaggggaccgctgctcgtgcttaacttccttcccgctcgcttcgacggccgagttgatgcgggcaccctccccttcgagacccctgataaattgagggccattagggaggaactgagaacttcccatgtagttgtaacgcgaggaaaagaggtcgtatgcgtgcccttcgttagtggcgcgaaattgatcggcaaacgaaccactatcaccgcagcgggacccgacctcgtcgtacaaacgagtcttctcgaatccagcctgaggcggaccttgaccgaaaaatggaagtacgaattgcgcagggaaaacccgctcacctttgtgtcaaggacgccaggaagggacctgctggagaaggcccttggtcgggagttgccgggactccatgtgttccccgcttacagcctggacgtgcgcagatacggtcctggggggttcagcggggttgttgtaggattgaagacccgctatgagatcgacctgcctgtcggagtgctgctcaggaggggcgttcaagtaaacggcctttatgtcctggctgaaagccccctcgcgcctacgtggcccttccaagatccccacaccagaaggcggctcgtgggacaagttgtcgcggtggatggcgacaaattgcgagtgaggtgtagggacggggagctggaacttgatgccgccgaagcatggattgagcccaacactgccaacttctacgccgtcctgcggaaggcgtgcggacgctcttacgaacgagactttcacgccctggaagcccaagtcgtgtccctgactaacgcccagcagcgaatcgccgataccaacaggatcgccgccaacctgataggccttggtaaattcgacatcagtaacggcttgactgccgagctggggaaaccactcagactgacttccactcaacatccacacgttcggactctggccgagcccacatttgtgtttgaccagagcggagacaaaaccgcgccttttcccgagaccgggctgaccaagtggggcccattggacgctgagagctttacacccaaggcaccacacatcgccgtggtggttccgcggcagtttcagggtcgcgtcgaaacgctggttgagcggttcaggaacggcgtgaggggcagcaacgcctatgccgagggctttgtccgaaagtttaggctcaccgactgtaccttcagcttcaccgtttttgacggtgacgctactgacgcagccgcatataggcaagcgtgccttaccgccctgagtaatgacgagcaaattaacctcgccttcgtcttcacatcagccgtgcaggagcatcaaacgggggacgacagtccctatcttgtcagcaaatccaccttcatgagccagggtatccccgtgcaagagtatcaagtggagaacatcatcggggattcaaacttggcttatcccctgtccacgatggcgctggcgtgctacgccaaactgggtggcaccccttacgccataagcgatcgaggacgacctatggcacgagaactgatcttcggcatcgggtctgcccaggtaagcgacggaaggatgggcgaaacagagcgatttgtgggcattaccaccgtgttcaattacgacggtaggtacttggttagcaacgttagccgcgagacaccctacgaaaggtacccgcaagccctgcttgacgcattgcggacttgcattgccgacgtgaaggttaggcagggatggaggtccgacgactttgtgcggcttgtcttccatatcttcaaacctctgaaggacaaggaagcacgcgccgtaaaagagctggtgacggagctgacgtctgaatatgccagcgtggagttcgcttttgtgacagtggtggacgatcacccgtggctggtgctcgatgaaaacagcgatggggttaaggttgggcgagggactaagggcaagcacgtagctcggaggggttttgccctgccgatttccaaaagggagcttcttgtgacggttaaaggtccccgggaaatgaaatccgataagcaaggggctcccaagcccctcttgctcaagctccatcgcgaaagcacctttacagacatcgactacctggcttcccaggtctttcaattcaccgccatgagctggcgcaggccataccctaccagcaaacccgtgactataagctacagtgacctgattgcgggacttctcggaaagctgcgacacgtgacgaactggaatagcgacatgatctacatgaagttgcgcttcagcagatggttcctgtagtaa

SEQ ID NO: 103 - DNA, 3198 bp, Artificial Sequence
  Description of Artificial Sequence: Synthetic polynucleotide
atgcctaagaagaagcgcaaagtcgaagaccccaagaaaaagcgaaaggtgggctctggcagtatgattaacaaactgcaattcgacgagtttcagagggccataggtatttctaagaacgacaccttcagtcttttgctcggagcgggttgcagcatcaatagtgacatccctagcgcggaagactgtatatgggagtggaagcgagatatttacaaaacaaataacagttctagcttcggctggattgacaattacaagaatcccaagactcaggagatcattcagaactggctcaacaaccaaggcatctatcccgaacgcggctgcaaagaggagtacagcttttacgcctacaaatgctatcccatcgacgaacataggcgacagtattttcagaaaatctgtagtggtaaaaagccatccatcgggtacaaacttattcccctgcttgcccgaaagggcatgcttgatagcgtgtggaccacgaatttggacgacctcgtggtgaccgcctgtataggcaacgggatccaggcgatcgaaatcacgctcgactccgtgcaaaggttgaacaaccggcctcagaaccgacatgagcttcctgtgatcaaactccacggagattttaagtatggcgatcttaaaaacaccgaggaggaactcctcaatcaggataaaacgttcagggagagacttattgaatacgtacaagacaagcacctgatcgtgctcggctacagtggccgagacaccagcctgatggacacacttaaagaggcctactcaaaacaggggggtggaattctgtactggtgtggatatggtgacaacataaactccgacatcgccgaactgattcaaatagccactaaaaatggccgacgagccttttacatccccactgatggtttcgattctacgctccggaaaatcacacagatagtggtcgaggatgataacaacctgaaaaaagagcttctcgagcttcaccagaccagcaatatcaatgacactatcacaccttttgatctgaagtgcgagagggtgaataagctgttgaagtcaaacatattccggattagctttccagacgaagtgttcgttttcgatgtgagcatcagcgataaaccctggaagttcgtggacgaaaggactcttgagcgcaacgatattagcgccgttccctataacaagcaaatctgggcattcggtaggcttgacatcataaaagacatcttcaaagacgtgatgaactcagacattcagcgaaaacccctggcaaacatcaagatatacaacacggcggttagtcggctgttgcttactacgatttgcaagatactggcgctgcagagcaaccttaagaccgactataagggtaagatatggaccgagaacaacagtaagtccatttccggccacatagtatacaatgccgtgctgctgtcctttgatcggataagcggtgagtattaccttagcctcaaccccgacttcgtgctggctaaccccaacattgagaagagtagcatacagaccataggactgttcttcttccagaagctgtggaatcagcagtttaacgagtacattaactattggagggaaattttgttgaaaaagaataatgagtacgagttccccataaatagcggaaccggcttcaagttcaagatcaagaacatcccagtgttcactaacatctgcgacctgaataaccctcgcatcaacaatcacaacgtgtccagccaccacctgctgcttcagggggtgcaatttaaggaaatcccgctgcttttcagcaccaacaatggcaaccgcacggccaccgacacccaccctatgagaggacttctcataaacaaaccgtatgaaacgggcgtcaacgacttcctcgaaaagtctatcaccctgggaatcataagccccagtcaggacgccctcaggttctaccaattcctggaaaaccagaactctaaaatcaaaaagcacaacgacaaggacaactacataatagactacgaagggtttttcgccatctacggcgttagtctcagcttcccaacacctaacgacaacgagtgggaaaggatcaacgaaccgctgattatgggcatcaaggagaccgcccaacagataaagcaactgatatgcgacagcatcgtgaagatctcaagcacgaccaggagaaaaatcatcgtcatctatatcccccaacgctgggagccctacacctcttaccagctcgatggtgagtcatttgacctccatgactacgtgaaagcgttctgcgcggagaaagggattatgagccaactcattcgagagaagaccattaacgatactatccaaaaatgccagatacattggtggttgtctctgtcatttttcgtaaaatccttccggaccccatggattctcgcaaatactaacaacaccaccgccttcgcgggtttggggtacagtgtagaaaacaagaaggatattaacggacatattgtgctggggtgtagccacatttacagctcaaacggagaagggctcaaatacaagctggccaaaataagtaatgataagattcagtggaggcataagaagccgcacctctgctacgacgacgcgtatgagtttggcaagtcaattgtgaacctgttctacgaatctatgaacgaactgccaaaaagggtggtcatccacaagaggaccttctataccgatgaagagaaacaagggatcatagactccattagcgacaataagaaaatagagagcatcgacctcatcgagatcaactttgaaaacaatataaagtacgcctctagcaaaatccacgacggaaaggtagacattgacggatttagcgtatctaggggaacctgcatacaactcagctctaaggaggcgctcctgtgggcgcatggagtgattcctagcgtcattaaccctaactggaacttctaccctggcggcaggtacatacctaaaccacttaggatcattaaacattacggtacaggtagcttggaacagatcgcgaacgagattctgggcctgactaaaatgaattggaatagcctgaacatgtacagccaattgcctgccacaatttcaagctccaatgatatagctaggataggtaaattgataggggcgaacagtatgcacgaatacgactaccgatacttcatctagtaa

SEQ ID NO: 104 - DNA, 3096 bp, Artificial Sequence
  Description of Artificial Sequence: Synthetic polynucleotide
atgcctaagaagaaaagaaaggtggaggatccaaagaaaaaacgcaaggtgggtagcggcagcatgccatcagccgagaggtgcatctgggagtggaagagggaaatcttcatcactaaaaaccccttgctcagggaaaccgtcggcgagctgtccctccagggcacgaaggaccgaatccaaaaatggctcgatcaacgcggcgaataccccgcactgaactccccagaggaatactcattttatgccgaggagtgctacatcaccgaacaagacaggcggagcttttttcagcagtacgtagaggtcgccaagccgcacataggttatagattgttgcccctgctggcacagaccaagatcataaaaactgtatggacgactaactttgacgggcttgtcgccagggcctgtcattccaacgacgtggtgtgcatcgaagtcggtctcgacaatacccaacgcattacgcgccagcattctgagggggagctgcgggttgtaagtctccacggcgactaccgatacgatgagcttaagaatacagatgagcagctcaggtaccaggaggaggcgcttaaaaacaatatagagcacgagctgcaggactacgacctggtagtgatcggttactccggcagggaccggagcctcatgaacgtactcgaaaacatattcagcaaggccgtgaagagcaggttgttttggtgtggctacggcgaaacgataagccagcccgttatggagttgttggagctggcccgcaagaataatcgagacgcattctatgtcagcaccgaaggcttcgacgacaccgttgaaagaatcagtaggaagctgcttgacggcaacatgctgtccaaagccttggctgagatacaggagaccacttgcatcaccaaccaatctgccaaattcaccgcacctgaaaacgacatcagcagccttattaagtcaaacgcataccccctcctgaagctcccgtctcagttccttaaagtgaccctcaaatacccggaggggtcctttagttacattgattggcttaactccaaggttgacttcaaggaggttgtgttgtctaagatagacaaggagatcatcgcgttcgcggatgttgataagctgaggaagtatctgggcgagttctacctgtctacgcccacggtggtgaactttagcaaaacggacgtgcttaacgatactcgcattcagagtctggtgaggcgcggacttatacagtccatcgtaaaaaacctgaacctgtccagcgaccagaacaagcgaatatggaatccagacgtgagctccatcgaattctacaacggcaagaagtacaaaatcatcgacgcgctcatcctcaatcttagttttatcaaagatgacatctacctcacgttcaaacccgatctgctggtccttaacctcgacgagagcctgccagacaacgatatagttaagactatcaagaacaaaaagttcggctaccagcacaacaaagagtacagtcagatcctggagaagtgggccaaccttataacgaagaaggatttggtcgtgagtggcgggagcgtgttcttccttgggaagaaaccgctgtatgccggacttgtgtcttacgccgcgaggaaactcccaacagattataacaagcacgccacccagaaaggactgatcattcaagacgcgaaactgattttttgcagcaattccatctccaatgagatttctcacatcaaccccctgaaggggctcgtggaaaatcgcccgtgggactacaaaaacaccagctctgggctgtgccccgagatctgcattaacgtgatctcaaccaggcaggacgcgggtgtggtgagcaaccttctccgaggtattcacgagaagtccttcccggaaaaatccgagcaagattacttgcaccccttccatgggttcacaaacgctttcggggtgcccatcacgatccctaagatcggtgagaatacgtggcgctttgtggacgaagcactgagtgcacagaaggccatcgataacgcgaagaacctcgcgaaccgcatttgctatgaacttgacagcctgaagaagcttgaactgcggacgggcaccgtcgtgatcatatacatccccaagagatgggaagcattgacatccatcaagtctgagcatgagtacttcgacctgcatgattacatcaaggcctatgctgcgcaacagggcattagtacgcaattcgtgcgcgagaaaacggttaattcaagccaaagctgccgggtaaaatggtggctcagcctggcgttctacgtgaaggctatgcgcactccgtggcggttggagagtattgataaccaaacggctttcgtggggatagggtacagcatcaatcgcaatatgcatcccgagaattccaagcggataattcttggatgctcccacatatactccgcccgaggcgaaggcatgcagtttcaacttgggcgaattgaaaatcccattatccaccatcacaatccctacatgagcgaggaggacgctagacgcaccggcgagaagatacgacaaatgttttttgatgccaagatgcaactgccacgcagggtcgtcatccacaagaggaccgctttcactgaagaggaacagcgggggttcatacaaggattggaaggcgttgaggacatcgagctgatcgaaattaacttcgaggactccctccgctatttgtctagtaagtttgtaaacagcaagctggaaatcgacgggttccccatcgctcgggggaccgtaatcgtgcaaagcagcaacaccgcgctcctgtgggtgcatggtgcaacccctagcgcgcaaaatccaacgtttaagtatttccaaggcaaacgacggatccccgtgccccttgtcataaagcgctacgtggggcagagcgacattagccagttggcgaacgaaatattgggcctcagcaaaatgaactggaacacctttgactattactccaggcttcctgtaacccttgagagcgccaatgatattgcccggatcggcgtgtatttcaacaatttctcccccatgagctacgactatcggctcctcatatagtaa

SEQ ID NO: 105 - DNA, 2301 bp, Artificial Sequence
  Description of Artificial Sequence: Synthetic polynucleotide
atgcccaagaaaaagcgaaaagtggaagatccgaaaaagaagaggaaagtgggcagcgggtctatgaataacgtgatgcaggagtttcccgtcgcaagcttccccacattcttgtccgagatcagtctgcttgacatcacaccgaagaactttatctgctttaggctcacccccgaaatcgagcgcaagaccggtaacagttttagctggcgcttcagccaaaaattccctgacgccgtcgtgatttggcataacaagtttttctgggtactcgctaagcccaatagaccaatgcccagccaggagcagtggagagaaaagttgctggaaatctgcgaggaacttaagaaggacataggcgacagaacctacgccattcagtgggttagccagccccaaataacccctgagatcctgtctcaactcgccgtcagagtgttgaagatcaactgtaggtttagctctcccagcgtaatttctgtcaatcaagttgaagtgaagagggagatcgacttttgggccgaaacaattgagattcagacccagatccaacccgctttgaccatcaccgtgcacagttcattcttctatcaacgacacctggaagagttctacaataatcacccttacaggcagaaccccgagcaactgctcatcggcctcaaggtgagggacattgaaaggaatagcttcgcgacgattactgacattgtgggcaccatagcggaccaccgccagaagctgctcgaggatgccactggagctattagtaagcaagcccttatagaggccccagaagagcagcccgtggtcgccgtacagttcggtaagaaccaacaacccttctactacgcaatggccgcgttgcggccttgtatcaccgccgagaccgctaggaagtttgacgtggactacggcaaactgctgtccgccaccaagataccctacttggagcggaaggagctgttggctctctacaaaaaggaggcgggtcaatctctggcgacttatggtttccaattgaaaatcagcatcaacagcaggaggcatccggagctttttttcagcccaagcgtgaaactgagcgagaccaaactcgtattcgggaaaaaccaaataggggtgcaggggcaaattcttagcggattgagcaagggtggggtgtacagaaggcatgaggacttcagcgacctctcaagacctatacgcatcgctgcgcttaaattgtgcgactaccctgcgaattcatttctgcaagagacccggcaacgcctcaaacggtacggttttgagactctgctgcccgtcgagaataagaaaaccctgctggtagacgatctgagcggggtcgaagcacgcgcgaaagccgaggaagccgttgacgaactgatggtgaaccaccccgacatcgtgctcactttcttgccgaccagtgataggcacagcgacaacacggaaggcggctcattgtatagttggatttattcccgactgctgcggcgagggattgcttcacaggttatctacgaggacacgcttaagagtgtggaggcgaaatatctccttaaccaggtgatccccggaatattggcaaaactcggcaacctgccgttcgtacttgcggagcccctgggaatcgctgactacttcataggcctggacatctccaggtcagcaaagaaacgggggtctggaaccatgaatgcctgtgccagcgttaggctgtatggtaggaagggcgaatttatcaggtacaggcttgaggacgcactgatcgaaggggaggaaatacctcagcgcattctggagagttttctgccagccgctcaactgaagggcaaggtagtgctcatttacagggacggccgattctgtggtgacgaggtccagcacttgaaagagagagcaaaggctataggaagcgagttcatcctggttgaatgctacaagagtgggattccacgactgtataactgggaagaagaagtcataaaggcaccaactctgggactggcccttaggttgagtgcgagagaagtgattctggtgacaaccgagctgaacagcgcaaaaatcggtcttcctttgcctctgcgactcagaattcacgaagccggtcaccaagtatctctcgagtctttggtagaagccacactgaagttgaccctcctccaccacggcagcctgaacgaaccgcggctgcctataccactgtttggttccgatcgaatggcctaccggagactccagggcatatatcccggattgttggagggggatcggcagttctggctttagtaa

SEQ ID NO: 106 - DNA, 2244 bp, Artificial Sequence
  Description of Artificial Sequence: Synthetic polynucleotide
atgcctaagaaaaagagaaaggtagaagacccaaagaagaagcggaaggtgggctccggttcaatgaacctgactctgttcaacgagatcctccccatcaacatcagccaactgcccaaccagtacttctacaagctgtgcactgccggcgacgtggacctggattctctgggcaggagcatcaagtaccggatccagaaatacttcagaggaatctgggtgtggagtaccaacgaccaactcctcatttcagacaagctcatcgagtaccccgaactgcaaaagttcacccagtatctgtggaccgaccagtctaacctcacattcaaccagctcgaggggatagaaatcgagaacattaggtgttgcaccccccaaggcatcgctgatttctgtagccaaggtctcatcaaaaagtacgaccagcagatcaagaagatactcgaacagtccaagacagcacggagagactatcatatcaaactgatccacaagttcggctcctgggtggtgaacaatcagccctgcataagcctgagcctgaaacaggagatcgattttaacggaactctccaggactacctgaccaagttccccaactctaacatcatcggcctgcatgtgctcgacatcactaagcctttcaacaccgcacaggaggtcatcaagattctcggtatcttgggtgagggaaatcggcggcagcgcctcctgacttgggtcaaggagccaaccatgaaaaaactcgtggaagaggccccagatagtgagctcgtagttgagatcgggaacaagaaaaaatcctatcattacatcatttctgccctgcgcatcagagtcctcaaccaagattacctgaggctggggattagcgagaagctgcaaatagtcagtgaagagaggttgaagtacatcgagccacttttccgcatactgcaatcagagggcttcctggacaaggtgtatactagccagcgcaaccccgagctgtttaggtcatgcagcgaggaatggggttacaatcccctgctgaagttcaagaataacgccactgttgcggcggaatccgtgcagtccacggtccaggtggtgcagaaacacggcgaattcaggaaagccgacaaaagcgaaattaggatcgccatactcaacacactgaagagtgaaaacagcaccaaattgattgagattttccgaaacaactttaagcgaagctttaaccagaatttggagggaatcggtaatcagcttaagtataaactcaagttggtgggccagcccattgcactggatctcagtaagaactccctcagcctgctggacagcaaaataggagaattgtctaaaaagaagccggacattgtgatctgtgtgatccctaacttccttagcaagggcgaagacgggcggacactttacgacgatttgaagcagacgttcctcaaatacaatctccaatcacaaatgttgcaggagaagactctcacgacgtcatttgccacaaagaacatcgtgttgggcgtgctggcgaaaattggaagcgttccctatattctgcaagaaccgctgacgtacacggactttgtcgtaggtttggacgtgagcaggcgacgcaaaaaaaacctgcaaggaaccaacagcgtagccgccatgacccgaatctacagcaatcaaggcgaactggtccactatagcatccgagacgcaaccatcgacggcgagatcattcccaagaggatgctctacgacctctttccacttcacgaatatcagggcaaacgcgtggtgattcaccgggacggaaacttccccgaggaagagcgccaggcactcgaggaaattgccgaaaagattgacgcgaagttctacttcgtaagcattatcaaatctggcaatcccaggatctacggtaggaccaaaaacgaagagggcatcggcagttatcgcaaggcacctaagggtagcattttcctcctcagcgagacggaggccttgcttatcagcagcgactttccggaccgcttcagggccacgccacagcctctcagaattaagacgtttggcaactttccccttcaaagcgccgtccatagcgttctgtcactcacctacctgcactacggttccgagcgcccaccgaggctgccggtgtctacctactacgcagatagcattagcactatggtatccaagggcattaagcccaaggacgttgacggcaatatacccttttggctgtagtaa

SEQ ID NO: 107 - DNA, 2184 bp, Artificial Sequence
  Description of Artificial Sequence: Synthetic polynucleotide
atgcccaaaaaaaagaggaaggtggaggacccgaagaagaagcgcaaagtgggtagcgggtccatgaaagagtttaacgtcattaccgagttcaagaacggcataaacagcaaatctattgagatctacatctacaaaatgatggtccgagatttcgagaagcgacacaatgaaaattacgacgtggtgaaggagctgattaaccttaacaacaactccaccatagtgttctacgagcagtacatcgcctcctttaaggagattgagaaatgggggaacgagcaatacataaatgtggagaagagggctatcaacctggagtccaacgagaagaaaattctggagaggctcctgctgaaggaaatcaaaaataacatagacaataacaagtacaaggtcgtcaaggacagcatatacatcaataagccagtgtacaacgagaagggcatcaaaattgacaggtatttcaatctggacataaacgttgagtcaaacggagacattatcatcgggtttgacatctcccataacttcgagtatatcaacactctggagtatgaaataaagaacaataatatcaagattggggaccgggtaaaggactacttctacaacctgacctatgagtacgtgggcatcgccccctttactatctccgaggaaaacgagtacatgggctgctcaatcgtcgactattatgagaacaagaaccagagctatattgtgaataaactgcctaaagacatgaaggccatcctggtaaagaataataagaactctatatttccctacatcccgagcaggcttaaaaaggtgtgcagattcgaaaaccttccccagaacgtgctgagggactttaacacgagggtgaagcagaagacaaacgaaaaaatgcagttcatggttgacgaagtgatcaacatcgtgaagaattccgagcatatcgacgtcaaaaagaaaaacatgatgtgcgataacattgggtacaagatcgaggacctgcaacagcccgacctgctcttcggtaacgccagggcccagaggtaccccctctatggtctcaaaaacttcggggtgtacgaaaacaagcggatagagatcaaatacttcatagaccccatcctcgccaagtcaaagatgaacttggagaaaatctccaaattttgtgacgagctggaacagtttagcagcaagctgggcgtggggctcaaccgggttaagctgaacaacatagttaatttcaaagaaatccgcatggacaatgaggacattttcagctacgagataagaaagatagtgagcaactataatgaaactaccatcgtaatcctgagcgaggagaacctgaataagtactacaacatcattaagaaaacattcagcggcggaaacgaggtgcccacccagtgcatcggtttcaatacgctgagctacacggaaaaaaacaaagattctatcttcctgaacattctgctgggggtttacgccaagagtggcatccagccctggatcctgaatgagaagttgaacagtgactgctttatcggcctggacgtgtctagggagaataaggtcaataaagcgggagtcatccaggtggtcgggaaagacggcagggtgctcaaaactaaggtgatcagcagcagccaaagcggagagaagatcaagttggagaccctcagggagatcgtgtttgaggcaatcaacagttacgagaatacgtaccggtgcaaacccaaacacattactttccaccgcgatggaatcaaccgcgaggaactggagaacttgaagaacaccatgaccaacctcggtgttgagttcgactacatcgaaattaccaaaggcattaacaggaggatcgccactatcagcgaaggtgaggaatggaagacgattatggggaggtgctactataaggacaacagcgcgtacgtgtgtaccaccaagccttacgagggaatcggcatggccaagcccatccgaatcaggagggtgttcggcacgctcgacatagaaaagattgtcgaagacgcctacaaactgacctttatgcacgttggcgcaattaacaaaatcaggcttcccattactacgtactacgcagacctgagctccacttacggcaatcgggatcttatccccacaaacatcgacactaactgtctgtactttatatagtaa

SEQ ID NO: 108 - DNA, 2613 bp, Artificial Sequence
  Description of Artificial Sequence: Synthetic polynucleotide
atgcctaagaaaaaaaggaaagtggaggacccaaagaagaagcggaaggtgggcagcggtagcatgcaaggcactatatccataaacgaggtgaggatccagcttaatactattaagaatctttcagtgttcaagtgcagcctcagcggaattagcacccgccataagaaccagatcgagttcatccttcgcagcgagcaaaaccgagttagcatctttgagggtgaagtgatctttgcgcttcccgtcgaacagcagaacctcgaaagagataagcaggctctgttcagcttcctggtcaaacaacaaagggatctcaatctgaaacagctgagcctggtgcccctgagggaggtgcccgagcgcgttatcgagcgactgactttcgcaatggttagctatcaggccatgaagcagggcatcttctctatctatggtcatacattttttcgccccacccttatgacggataggcttgcgcacaaggcggtggaagtcacgacgtgcatcgaggatggcttcctcaagttttatctggacccgacgtacattgcactgacatgcataacggacacagcacgcgaaaatagggagaacctggaactggtcgggctctgctctttccgcaacaaaaacctttgtagccttgtcaggccggacggctcatgcaactgcctcatacctggtaagttggggtattacgtccaggagatggggattaaggacgttgaggatgatagcaaggactttctggccaaacggttcaatagctgtccccggtttagtgagcacacgcgctttatacaagtgaaggcgagtaaaagaggcacgaagtactccctgttcccttcttacgtagtttttagcaggttgtcccgaatggacctgtccgctaagccagatgtgcggtccagttatcggaaggccacattgatggactctcacgaaaggcttaacttgaccaacgactggataagacaaattttcatgatcgggcagaagggccttcaaaattggggtgttataaaggtcaaccagaccgagattcccgttgaaattgtactcacaattgcccacgccatcgcgcccaagacttctcaaggcatctataaggctatattcctcccggaccagcaaattacgaatgacagcaataacccaacgcctcaaacgctgagcgggggttggctcttcacgaataggggtgcgttcgacaggagggatcctaataggccttttaaagtaatcagcccctacatcatcgtgcccaacaatgagcaaagcatcagctcttgccgccagctgatcaactacttcagcaacggcaggtacaaggcccggtgcaagggtgacagagactttattggtatttcattgcccgaaaacaagggcaagtacaacacatcatttgtcaatgctttcgaagaggaggacggcctgtatttcgttgaagagacgatacagggctaccagaaggcgctgcaagacattgttagagactggaatatcacgtccaagcgggacatcaataaacacgctatagtgatcataccgggcgagaacgatattgacgacaatcctttctattatcaactgaaaaaggcgttcgtagaggaagggattcccagcaccttcatcacgtacgagactatgaacaaaatcaacgaccccgacatcgcgttcgggccaatcatggacagcctgtggttgaacatttacagcaaaatggggggcaaaccgtggcgcctcgctaatagcctcggcaacgtgcactgctttatcggtattgggtttggaattaaccccgagaccaccggaaaccacatattcgcagggatcgcccacatcttcgacaactacgggagttggatagacgtagcgagtgattccgccaacctctcccaaaacgatctgaactcattcgagggcacggaaaagtacacacaggggagtgctagctttaagatcagtcagagcgtgtcccagtccattgtgtataacgcattgaagctgtaccaacagaagcaaactaagacccacgaaaacgccacaaacatcgtcctgcacaaactgggccagatctacgagtgtgaggtcatcgggttcctcgaaggaattcgccaagtgctcgggagtctgggcgactgcaagctgggattgctgcaaattgagcaggagcaccacctgcgcctctatggcgcagcagcccaaaccggcaaggagaacaacacgatctttcgcggttcagcacttcaactcaacccggagaagctggttatcgcgtccactggccgctcttaccggcagacgagctccgggctgtttatgaattatccgggcatcggcaccccccagccgctcctgttgacttctatcgtaccgaatcagcagatcctgcagaagtacggctgtaacgcaaaccaattctactcaagcgaggacctggcgaaacatgcaatggccctgacgcaacttcactgggggtcactgaaggataatgtaagattgccgattaccacgctttacgcgcaaaaggtcgccgacttgattagcaagaccaacatgcggatcaatccaggcttgggctacttccgaccctggtttctttagtaa

SEQ ID NO: 109 - DNA, 2304 bp, Artificial Sequence
  Description of Artificial Sequence: Synthetic polynucleotide
atgccgaagaaaaagcgaaaggtggaagacccaaagaagaaacgcaaggtgggctccggcagcatgaataacctgacactggaggcctttcggggcattggcaccatcaagccactgttgttctatcggtacaagctgatcggcaaagggaaaatagagaatacctataagacgatacgcaacgcacagaatcggatgtctttcaacaataagtttaaggccaccttcagtaaggatgaaatcatatacaccctggagaagttcgagattatcccgacgctggatgatgtgacgatcatcttcgacggggaagaagtgcttcctataaaggacaacaacaagatttacagcgaggtaatagaattttacattaacaacaatctccggaacgttaagttcaactataagtacccgaagtacagggctgccaatacaagggagatcacgggcaacgtgatcctcgacaaagatatgaacgaaaagtacaagaagagcaacaaaggcttcgaactcaaacggaagttcataatcagccccaaggtcgacgatgagggtaaggtcacattgttcctggacctgaacgcgtcatttgactacgacaagaacatctaccagatgataaaggccggaatagatgtggtaggagaggaggtcatcaacatctggagcaataagaagcagcgcggtaagatcaaggaaatcagcgacattaagataaacgaaccctgcaacttcggccagagcctgatagattactatataagcagcaatcaggcgtcacgggtgaatggatttacggaggaagagaagaacacaaacgtcatcatcgtggaaagcggcaaaagccgcctgtcatacataccgcacgcgctcaagcctatcataacgcgagagtacatcgccaagaacgacgaagtctttagcaaggagatagaagggctcatcaaaatcaatatgaattacaggtacgagattctcaagaggttcgtctccgacatcggcactattaaagaactgaacaacctgcgcttcgagaaaatctatatggacaatatagaaagcctgggttacgagcagggtcaactcaaggaccccgtgctcatcggcggcaagggtatacttaaagacaaaatacatgtcttcaagagcggcttctacaaatcccccaatgacgaaattaagtttggcgtgatatacccgagaggctacataaaagatacccagagcgttatccgagccatctacgacttttgcaccgagggcaagtaccagggaaaggataacatattcatcaataacaagctcatgaacatcaagttctccaataaggagtgcgtctttgaagagtacgagctcaatgacataaccgagtataagcgggctgcaaataagctcaaaaagaatgagaacataaagttcgtgatcgcaatcatccccactatcaatgaaagtgacattgagaacccctacaaccccttcaaaagggtctgtgccgagatcaacctccccagccaaatgatcagtctcaaaactgcaaagcggttcagcaccagcaggggccaatctgagttgtatttcctgcataacatcagcctcggcattttgggcaaaataggcggcgtaccctgggtaattaaggacatgccaggcgaggtcgattgttttgtgggcctggacgtgggcacaaaagagaaaggaatccactaccccgcatgcagcgtgctgttcgacaagtatggcaaactcattaactactacaagccgacgatcccgcagagtggagagatcattaaaacagacgtgctgcaggagatctttgacaaggttctgctgagctacgaggaggagaacggccagtatccccgcaacatcgtgatacacagggacggcttcagccgggaggacctggagtggtataagaactacttcctgaaaaaaaacatcgaattcagcatagtagaggtccgcaagaactttgccacgcgacttgtaaacaacttcaacgatgaagtgtccaacccaagcaaaggttcattcattttgagggacaacgaagcgattgtcgtcacgacggatattaacgacaacatgggagcgcccaaaccgatcaaagttgagaaaacgtatggcgatattgacatgctcacaattatcaaccaaatttacgcactgacacagattcacgtggggtccgcgaaatcccttagactgcctataaccacgggctacgccgataagatctgcaaggctatcgattacatcccgagcggccaagtcgataacaggctgttctttctgtagtaa

SEQ ID NO: 110 - DNA, 2211 bp, Artificial Sequence
  Description of Artificial Sequence: Synthetic polynucleotide
atgcccaagaaaaagagaaaggtcgaggacccgaagaagaaaaggaaagtgggcagcggcagcctgaaaatcaaaattctcaaggagccgatgctggagtttggcaacggcgctcacatatgccccaggaccggtatcgaaaccctgggagtgtacgataagagagatgaactgaggaggagcgagctgcgaataggcattgtgggtcggggcgagggcgtggaccttctggatgagtggctcgacaagtgcaagcgcggcatcgtgggtaaagaggagaccaagttccccaacttgttcaggggctttgggggcgtcgatgagtaccacggtttctacaccaagattctgagcagcccccagtatacccggactttgcagaaaagcgagattaacaacatcagcaagatcaccgcccgagaggacagggtagtgaagtgcgtggagctgtactacgagcagatccgattcctgtcagagaacaggagcattgacgtgatcgtgtgcgtcgttcccaatgatattttcgacagccttactaaggccaccggagacaaagacaccgagtccctggaggcctacctcgagcacaactttagacggttgctcaaggcccgctgtatgcaccttgggatacccttgcagcttgtgagggagaagaccatcctgagcgtgaagcctagcatagaccagcaggaccttgccacaaaggcttggaacttctgtacggccctctattacaaggggaataggactgtaccatggcgcctggtggaggataaattcaagcctaagacctgctacatcggcattgggttctataagagtagagacggcgaaacggtgagcacatcacttgcacaggtattcgacgagttcggccacggggtcatccttcggggagcaccagttagcctggacaaacgagacaagaggccctacatggacgagtctcaggcttacgaactgctggacagtgccctggcggagtacgagaaggccctgatgcaaaagcccgctcgagtggtgatccacaagagcagcaggttccggcccaccgaggtgagcggcttcagcagagtgctgaacgcgaaaggaatcagaacgaaggacctcgtgagcatcacatcaaccgacatccgcctgttcagcgacaaaaactatccccccacccgcggtaccttgttgtccctgtctgaaacacaaggagtactgtataccaagggaatcgtagatttttacaagacctatccgggcatgtatatcccttcacccctgagggttgaggcgttcgagtccgacagctctcttgaagacttgtgtaaggaaatcctgggcctgaccaaaatgaattggaacaacacacaactggacggccgactgcccattaccctggaatgcgccaataaggtgggcgatatcatgaagtatgtggacgcatccgaaaagccacaggttggtgtggcgctgtttatcttcatgttggagcaactcgtacccggctggaagctgcctaaggtgagtacatgggtagcacgggtaattttcctgaatattgtacaggtgtctatcgctctgcttgccgggattacttggaataaatggatgatgggccacagtttgttgcataccagcgatgccctgccccccttgctcgcaggattcgccgcctacttcgttaacaccttcgtgacctactggtggcacagggccaggcacgccaacgacaccctttggcgactttttcaccaactgcaccatgcgccccagaggatcgaggtgtttactagcttctacaaacacccaacggaaatggtattcaactctcttcttggcagtttcgtggcctacgtcgttatggggatctccatcgaagctggcgcgtattacatcatgtttgcggctcttggcgagatgttctaccacagcaacttgcgaacaccgcatgttctcggttatctctttcaacgccctgagatgcaccggatccaccaccagagggaccgacacgagtgcaactacagcgatttccccatctgggacatgctcttcggcacctacgaaaatcccaggagaatagacgaaccacaggggtttgccggcgacaaggaacagcaattcgttgatatgcttttgtttagggacgtgcattccctccccgggaagacacaaccagctcccgtactcgtcaaacccgacgtgaggtagtaa

SEQ ID NO: 111 - DNA, 2166 bp, Artificial Sequence
  Description of Artificial Sequence: Synthetic polynucleotide
atgccgaaaaagaagcggaaagtagaggacccgaagaaaaaacgcaaggtgggctccgggtctatggccaaccatacctttaacatcctgactttcaaccacccccaggaggaacagaccttctacttcacggaccaggagcaagacaacctgacccgcatctacaagagcctggtgcccgacgaggtcatcgagaaatatggcgagcaggatcactactacacctctttcaccgtagagaaggatggtttcctggccgtcagcaagcccacaacgcccctgttcgagaccaagactacggaggcgggcgaggagaggagctataccatcaggaattcaacgttcagcagcagcgtgttgaaacggtactacaacagccttatccacagccacttcaaggagaagggcttcctggtgaagcccaacttcgtgagcgacacggaggtgtggctgcctagcgccaagcaggacacgaccggcaaatacaaaatattcgaccgctttagcctgaaggtgcagttcaagaccgtctctgattccctggagttgctcgtcacgttcgaggggaagtcaaagatattcaaagtacctgttagcaccctgctggaggatgtgagccccacggacatcaactgggttgtgtacgaaaagggattgtacaggttcgacgaactcccggacagcggcaagagggagtatgacaaggtttaccccgtgtggaccttcgagatcagggacgcgcttatgcagggcaccgaagccccagacaagaccaacaagtacaaaaagttcagggagggcatcgacaagttctataaccagtatctgaacacagaggagttcaaagccatcattccaatcacgtctaatggcttcatcccggtcaataagatcaatgtcggtagtgtgaataatagtagcaacaggctgctgttcggggaacaaaagagcggtatcgtgccaatggacggcatgaaggaacatggcccattcgacttttccagcaccagcaagatccatttcttctttatctttcataaagacgaccagcacatcgcccaaaagatggatggctatttcaaaggcagcgagttcgggttcaagggactcaccaaattcatacacaccccctatcacaccgagaaaggattctcaatcaggtttgaggaccgcgacaatccgtggcccgagatctacgaagccgtcactaacaagcacttcgagtccgacatacaatacattgcgatctacatcagccccttcagcaaaaacagccccgacaagagtcggcgcaaaatctattacaagctcaaagaactgctcttgaaagaaggcgtgagcagccaggtgattgacggcgagaaggtgatgaccaacgagaagtattactacagcctccccaacatagcaatcgccattctggccaagttgaatggcaccccttggaaactggacaccaagctgaagaacgaactgatcgtgggaatcggcgccttccgcaacagcgaggttgacattcaatatatcggcagcgcgttctctttcgcaaacaacggcaagtttaatcgctttgagtgcttccagaaggaccagacgaaagaattggcgggaagcatcatacgggcggtgaaggagtacgccaacgtaaacaccggcattaagaggcttgtgatccacttttacaaaagcatgcgacaggatgagctccagccgatcgaggacggccttaaagacctcggcctggacattccggtattcatcgtatctatcaataaaacagaaagcagtgatatcgtggcgttcgataacagctggaaggatctgatgccgatgagcggcacattcattaaagtggggtacaacaaatttctcctgttcaacaacaccaggtataatccaaagttttacagcttccacgacgggttccccttccccatcaaacttaagattttttgcactgaaaaggaactcgtggaggagtataaaacggttaaagagctgatcgaccaggtgtaccaatttagccgcatgtactggaagtctgtccgccagcagaacctgcccgtgaccattaagtatccggaaatggtggccgaaatgttgcctcactttgacgggaatgagatacctgaattcggtaaggacaacttgtggttcctgtagtaa

SEQ ID NO: 112 - DNA, 2199 bp, Artificial Sequence
  Description of Artificial Sequence: Synthetic polynucleotide
atgcccaagaaaaagcgaaaagtagaggatccaaagaagaaacggaaggtcggcagcggaagtgtgaaccattactatttttccgaatgcaaggcggacgagaaagccagcgacatagccatccacctttacaccgtgcccctgtccaacccccatgagaaatacagctatgcgcacagcatcgcctatgaattgagaaaactcaactcatacataaccgtggccgcgcacggtcagtacatcgcgtctttcgaggagatatgccactggggcgaccacaggtacatacagcacgaacatagaccaatccagtgcagcctcccgatggagaggaccatactggaaagactcctcaagaaagagctcgagaataggtgcaaaagcagctataagatggacaacgaccttttccggttggctaacgagcaaagcatgcacgtgggcgagatcagcatacacccagcgatctacatctcattcagcgtggaggaaaatggtgacatatttgttggcttcgactaccagcaccggttcgagtaccgcaaaacactccaagacgtcatcaacaacgatccctccctgcttaaggaaggcatggaagtggtggaccccttcaatagaagggcctactattacacttttgtgggcatggccgattataccgccggacagaaaagccccttcctgcagcagtctgtgatcgactattatctcgaaaagaatgagctgtggaagctcaagggtgtgcacgaaaaaacccccgtggtgcacgtcaagagccgagacggtcacttgctcccgtatctgccgcacctgctcaaattgacatgttcatacgaacagctcttgcccagcatgaccaaggaagtcaatcgcctgattaagctgagccccaacgagaagatgagtaagttgtatacggagatgtttcgattgctccggcagcaacaggtgctgaccttcaagaaggaaaacgtgcgagccgtcaacctcggctacgatgtgaatgaacttgacagcccgatcatggagttcggacaaggctacaagacaaacgagatctatcgaggcctgaagcagagcggagtatacgagcccagctcagtggccgtgagcttttttgttgaccccgagcttaactacgacccccagaagcggaaagaagtaggttgcttcgtcaaaaaactggagagcatgagcgaggccctgggagtaaaactgaacataagcgaccagccccgacaactttatggccagctccccaaggactttttcaagcaggacaacctctcatatcatttgaaatctatcaccgaccagttcaggggaacggtggtggttgttatcggcactgaagagaacatcgaccgggcatacgttacaatcaaaaaggaattcggcggcaaggaggatctgatgacccagtttgtcggcttcacctcctccctcgtcacggagaacaacatttttcactactacaacatcctgctcggcatctatgcgaaagctggtgttcagccctggatactcgccagcccaatgcactcagactgtttcattggactcgacgtaagccacgagcacggtaagcacgcatcagggataatacaagtgattggacgggacggcaagattatcaaacaaaagagcgttgcgacagcagaggccggagagactattgccaatagcacgatggaagaaatcgtcaacgaaagcatttattcctacgagcagatctacggggccaaaccgcgccacataacattccatagagacgggatctgtcgcgaggacctcgattttctgcaagcgtatttgcggagtttccaaatcccattcgacttcgtagaaatcataaagaagccgcgacgcagaatggcgatatactctaataagaagtgggtcacgaaacagggaatatactacagtaagggcaacaccgcttatctgtgtgccacggaccccagagaatccgtgggtatggcgcaacttgtcaagatcgtacagaagactaacggattgagcgttcacgagatagtgagcgacgtgtataagctgtccttcatgcacatacacagtatgctcaagaccaggttgcctatcacgatacactatagcgacctcagctcaacgttccacaaccggggcttgatccatccccggtcccaacatgagagagcactcccgttcgtgtagtaa

SEQ ID NO: 113 - DNA, 2316 bp, Artificial Sequence
  Description of Artificial Sequence: Synthetic polynucleotide
atgcctaaaaagaagaggaaagtagaagatccaaagaaaaagcgaaaggtgggaagcggcagcatgaccggcgagactaaagtgttggtcgggaggcaacccttcgacgtggatcggctgaatgaactcagagacgaattccgggagacgcacgtgttcagaagggatggcatcgacgatgtcattgttgatgttccggtcgtggccggacagaagcccatcggcaacgtccaggaggaaatagacctggctaggtaccaaaaggtgtggccctccctcctcagtgctgctcttgtccgggcgtttagcggcgtaagggacatcctgagcgataggcccgtgagcgtggtggggagcacactgcggggtctggttcaacatccggaactccccgaatggatgcagaaacgcacactccttaggttcgacacccggaccatctatgctggtgataaaagaacctttggcttggtgtgcgaggccagattgaaaaaccttatccaaggtagttgcgcggagctgctggcacttggagtttccccactgggtcgatatgtccaagtcgaggagccacattacgatcccaggcttatgaaaaaacggcgccttgtgggcagggtatcagcgatctccggcgataatctggtgctggaggaccatgccgagggctttccgaccgtgagtgcaaagctggcatttctggaggcgcgaagggagatttttgacgactgtgtgcggaggattttgaactctgatgcggcctccgtgctgaacaaggccgaagctactgctgcctcatttcactcagggccaggtaggaaagagcaaatagaggaggctctcaagtatctcagggagaaggtgagcctcgaagctgtacccggagcgaaattcgtgatcgggccgatgctgagtagcggcaacaagggcttccccatcacggagatgatcccgaaacccattctcgtgttcgatccgagcggtacacggaaggatgagtggaacgaaaggggcattaagaagaacgggccctacgaccagaggacgttttcacctaagcagttgaaggtggcggtcatttgccaggcgaagcacgaggggcaggtggatggattcatcgcgaagttcttggaaggtatgccagacgttatgacgggcaagaaccgagttgctagatatggtgacggttttctgcggcgattcgcccttgagaaaccttctgtgaccttcttcacagcgccctcagccaaggcgagcgattacctggtggccagccgggctgcgctgaccaaggcaacggacgagggtttcaaatgggacctcgcgcttgtgcaagtggaggaggagtttaagggattcgacgacgagagcaacccctactatgccactaaatccgtcttcctgaagcgagacgtgccggtccaaagtgtacgactcgaaaccatggctcaggccgacagccagctgattttctctatgaaccacatgagcctggcgacatacgccaagctcggtggtaccccctggcttttggcgtcacagcagacggtagcgcatgaactggttatcggtcttggcagccacagcgtggccaacagcaggatcggtagccagcaacgattcgtcgggattacgacggtgttctcctccgacgggagctatctgctctcagaccgcacggcggttgtcccctatgaggagtatgcgactgcgctttacgatacgctcaaacggagcatcactacggtgaggaaacaagacaactggaggtctacggataaagtccgcctggtgttccacatgttcaagccccccaaggacaccgaggccgaggctataaaacggacagtggacgatctggagctggagaacgtgactttcgccttcgtgcacatcgccccatctcatccctacctcatcttcgacaatacacaaaagggaattggtttccgagaccccaagaaggggatactcggacccgagagaggtctgcacttgaagctgggggactacgagtccttgatcgtattcagcggcgcaagcgagctgaaacaggcaagtgacgggatgcccaggccatgcctgctcaagttgcaccggcttagcacgttcactgacatgacgtatctggcgcgacaggcattcgagttttcaggtcattcatggcgaatgctctccccagaaccgttccctataactattaggtactccgacctgatcgccgaaaggctcgcaggtctcaacgccgtcccgggttgggacgcggaggctgtcagattcggccaaatcggccgcacgctctggtttctgtagtaa

SEQ ID NO: 114 - DNA, 2535 bp, Artificial Sequence
  Description of Artificial Sequence: Synthetic polynucleotide
atgcccaaaaagaaacggaaggtggaggacccgaagaaaaagcgcaaagtaggtagcggcagtatgcgattggggcacataggcaacggctgttacagggaaggcgttaaagcacaattccagacacgagagagggaggatgccggttcaagggctgcggctgcccaacccccgattaagcaattcggatacaccgatagactcggcctgaacctcgcccccataaggttttctagcgaagagtttgaagccggacggacggtgtaccgcgacgaggaacagtaccgagctcttagggaagcccatcaagccacccatgcctttaggtatgacgcaagggacgcggctatatacgacatccctatggcagaaggggtggcgcctctgggtactcccgtgaggatcaaaactaaggaccacctcgctctgctcggcaaagcggctaaccacgcgctgctcgattggctcgcaccacgcagaaccattctgcggagggcgagacctcttcagtgctggggcaacaggaaggcctcactgttgtcagccgccgtgcgggatcaaggacttgccgaaacaaagggtctggatgttctggtaaggcattcttttgatttgagggctttgggcgcacctcaccagggtgctgaaccgtaccttgccctgatgttggacgtgagtacgagcaatgagctggagatacctgtgggcgagcttctgcgcgagagattcgaccccatcggtcgatacgtttgtgccagagccgactctggccaagataacgtacttgctaggttggaaacactgggtagggtcgtgggtgtggatggtggtaagcttcaactgaacgactttaccggagaagaattcgtggacgctgattcagtcacgttggagcctagattggagaatctcgatgcgctcattcgccacttctatcccagggatgcgccaaaaatcctggagggccttcgcaaaaggagagtgcctttctccaccgcgaacgacaagctggcgaagatacgagaagtgcacggaggagtagccggccaccttgaaacgattaggatcgctggcatggctatagaggtgggtgccctgctgcagagaggctctaacctgtttcccccactcataagcacggaccggcctggatttctgttcggcgctcaaggtagggaaactggcgcgttccccgacgtgggggtgaagcagcatgggccctacaagtacatgcaacacgagcgcaatgaacctgtgatcgccatcatctgcgagagcaggtttcggggtcggatagaccaactcgcccgaacacttcgcgatggtgtcgcggaagatgcctggcaagacgcgatgaggggcagaaataaggtgccggaaaacccctttagaggcgggctgatcggtaaattgagattgtctcgggtgcagtttgagttcgaagaagtaaccgagcccactcccgaagcctatcgcgaggccatccttcggctgcttgcgagactcccagagacacccgacctcgcgttggttcaaatacgagcggattttaagcagctccgcaacgacaggaacccatacttcgctgcaaaggccgcattcatgacggtgggagtgcccgtgcagtccgtacaagccgagactgcggacatgcagcccagtaatttggcctacatggccaacaacctggccctcgccgcctacgcaaaattgggcggtagtccgttcgtgatctccacacgcatgccggcgacgcatgagctcgtggttggcttgggctacacagaggtgtcagaaggacgctttggaccgaagtcccgatttgtaggcatcaccaccgtgttccaaggcgatggcaggtacttggtgtgggggcaaactagagaagtagaatttgaaaactacgccgacgctctcttggcgagtctgaagactaccatcgacacagtgcgcaaggacaataactggcagccacgcgatcgagtgaggttggtattccacgtgtataagccccttaaacatgtcgagatcgacgctatcaaacagttggtgcaggagttgctgaagggcgaacatgaagtggagttcgcatttctggacatctcccgcttccacgattttgcccttttcgatccttcccaagagggcgtgaattactacgctgaccgcagacgactgctgaaaggcgtgggcgtcccccttaggggtatctgcctccaactggacgaaaggagcgtgctcttgcagctgacaggcgctaaggaggtgaagaccagtgaacaaggtctgcccaggcccctgcgactgacgttgcattccgagagtgattttagggacctcacatacttggcgcgacaggtgtacagctttagctacctctcctggcgcagctacttcccggccatagagccggtgagcattacctacagcagacttattgccaatgcacttggcaaccttaagagcatcccgaactggaacagcacattcttgacagctggcccactgaggtcaaggatgtggtttctgtagtaa

SEQ ID NO: 115 - DNA, 1989 bp, Artificial Sequence
  Description of Artificial Sequence: Synthetic polynucleotide
atgcctaagaaaaagaggaaagtggaggatccgaagaagaaacgaaaggtcggcagcggcagcatgtatcttaacctctacgaaatcaagatcccctacagggttaaacgattgtactacttcaataaggagaacgaccccaaagagttcgcccggaatctgagccgagtgaacaacatacggttcaacgacagtaaggacttggtgtggctcgaaatccccgacatcgacttcaagattacaccccagcaggcggaaaagtacaaaatagaaaagaatgagataattggggagaaggaagacagcgatctgttcgtcaaaaccatttacaggtacatcaaaaaaaagttcatcgacaataacttctactataaacggggaaataactacatttcaatcaatgataagttcccgctcgattctaatacaaacgttaatgcgcacttgacatataagattaaactgtacaagataaacgaacggtattacattagcgtgcttccaaaattcaccttcctcagtgacaagccagcccttgagagccccatcaagagcacctacctgttcaacattaaaagcggcaagacgtttccctatattagcgggctcaacggagtcctgaaaattgacctgggcgagaacggcataaaggaggtcctttttccggagaactactatttcaactttacctccaaggaggccgagaagtttgggttttctaaggaaatccataacatctacaaggaaaaaatcttcagcggctacaagaaaatcaaacagagcttgtatttcctcgaagacatcatcaatataaacaattacaaccttaccatggacaaaaagatctatgtgaacatagaatacgagttcaaaaagggcatcagcagaaacataaaagacgtgttcaaatacagcttttacaaaaatgaccagaagatcaaaattgcgttcttttttagcagcaagaagcaaatctatgagattcaacgcagcttgaagatgctgttccagaacaagaatagcatattctaccagaccatctacgagatggggttcagcaaggtgatttttctccgcgagccgaagactaacagcagcgcatttatgtataaccccgagaccttcgagattagcaacaaagatttctttgaaaacctggaggggaacattatggcaatcattatactcgacaagtttctgggcaatatcgacagtcttatccaaaaattccctgagaacctcatccttcaacccatactcaaagagaaactggaaaagattcagccgtatatcattaagtcctacgtctataaaatgggaaactttattccagagtgccaaccatacgtcataaggaacctgaaggacaagaacaaaaccctctacatcggcatcgacctgtcccacgacaactatctcaagaagtctaacctcgccatcagcgccgtaaacaacttcggtgacattatctacctgaacaagtataagaaccttgagttgaacgagaagatgaacctcgatatagtcgagaaagagtacatacagatcctcaacgagtactacgagcgcaataagaattaccccgaaaacatcattgttttgcgagacggacgctatctcgaggacatagagatcataaagaacatactgaacattgagaacatcaagtacagcctcatcgaagttaacaagtccgtgaatatcaactcctgcgaagaccttaaagagtggattatcaagcttagcgacaacaatttcatatactatcccaaaacgtactttaaccagaaaggtgtagagataaagataatagagaacaataccgactacaataatgagaaaatactggagcaggtgtactcactgacgagagtggtgcatcccaccccctacgtaaactaccgcttgccctaccccctgcaagtcgtcaacaaggtcgcccttaccgagttggaatggaagctttatatcccttacatgaaatagtaa

SEQ ID NO: 116 - DNA, 3225 bp, Artificial Sequence
  Description of Artificial Sequence: Synthetic polynucleotide
atgcccaagaagaagcggaaggtggaagatccgaagaaaaagaggaaggttggcagcgggagcatgactgaggacttgtacctcgactacgacgcgttcctgcggagctttaaaagaaacatagatgtgccgcactcctttctcctgggagcaggtacatccattagcagtggcatccagaccgcctacgattgtatctgggagtggaaaaaggacatttacctctccaagaacatcaacgccgctgagttctataagaaccataaggacgaggcggtaagaaagagcatccaaaagtggctggataaccaaggtgaatacccagttctcgacagcacggaggagtattgcttttatgccgaaaaggcctatcccatccccgaggaccgccgcaagtattttctgtctcttatcgaaaataaggagccctacatagggtataagctcctctgtctgctggccgagcgcagcattgtaaaggctgtctggactactaatttcgatggcttgaccgtcagggctgctcatcagaacaagttgacgcccattgagataaccctcgataactctgatagaatatttcgcaaccagtctaccaaggaattgctcacaattgcgctgcatggtgactacaaattctctacgctgaaaaatacggagaaggagctcgacaaccagaacgacacattcaaacagcagctggggacgtatcacgtggacaagaatatgatcgtaataggctactcagggcgcgacaagagcctcatggacgccatcagcgaggccttcagtacgcggggtgcagggaggctttattggtgcggctatggcgagacgatccccaacgaggttagcgagctcatactgaaaatcaggtcccagggtcgcgatgcatactacatatcaacggatggatttgacaaaacgctgatacacctgtctaaaagtgcgttcgaagacaaccccgagattacgaaaaacatccaactcgcgctcgaaaacagcgcggacgaagagtactttaagactgacttttcactgaactttagcaagccggataagttcatcaagtcaaacctccaccccatcgtgttcccgaaagaaatctttcaattcgagcttgacttcaaggaggacaagccttggcaactcctcaaaactatttcacgcgagacaaacatttgcgccgtgccgttcaagggtaaggtgttcgcactgggcacgcttactgacattgggaacgtcttcaagaaccgcctgaagagtgatataaagcgcgaagcaattagcacctccgacgtggataatgtgagtgcctttaaatctctgatgctgcaggctgtgctgaagtttttcattggtatcgaaggcgtggagtccaacctcaaagacagattgtggcttaccaacgcggagcagctcgtgggtgatattagtgtgcataaggctatccacctcagcctgtacttcgacaaaaacaaaggattcgcttacctgtccttcacccccaccgtacaactcatctctcctgaggaaatcagcaaaatccagaagcagagaatctctaagagtaaactcgagaagctgttcaatgacaagtatgacgagatattggagttctggaaccaaaagctctttaacaatagccaaatcaagttcgagtacccgatcagctcaggtagtgggtttgagttcaaaatctccgccaacaccgcatttggggagataaacgtattggaccccaactttcgctccttttcccctagaaattatgacccgaagcgcacacagtttaagggcgtgcagttcctcgaaccgcagctgatattccgcaacatcagtactaatgtggaatttaaggactaccacccgatgagggggctggtgaacaaccgaccgttcgacgtgaacctgaacggtataattcattctaacgaaataaacctcacggtcatctgcggcaagtcatacgccaacgacctgtatgaattcctgagcaagctccaagtgaagcacgccactgagaatgtcaacccggactatcttattgagtatccgggcttccaaagtgtgttcaacctgccactcaacataccccactttgactcttccgagaagtggtacgacatcgacttcgtagctgacaataacggggagaaccacgagaatgccattaagcttgccagactcatcaccaccaagatcgaccagattgcctctacacagaaccagagcacggtcgtggtgtttattccaaatgaatggcagttgtttgaggggtacctgaatcagggggagagtttcgatttgcacgattacatcaaggcattcagcgctagtaggggcatttcaacgcagctcatccgcgaggatacactggcggatacgttgaagtgccagatctactggtggctgagcctctcattttacgttaaaagcctgcgaactccttggattctgaataatcaagaaaagaacacggcctacgccgggatcggttatagcgtgactaaaatacaggaccggacggaaacggtgatcggctgttcccatatttacgattccaacggccaggggctcaagtatcggttgagtaaaattgacgactacttccttgacaatcgcaataatccatttcttagctataaggatgcgttccaattcggtgtgtccatacgggaattgttttaccagtccctggacaaattgcctgagcgggtagttatacacaagcggacccgatttaccgatgatgagatcaatggtattaaggcgtctctgaacaaggcggggattaagaagattgacctggtggagattaactacgagacggacgcccgcttcgtggccatgtccgtataccagaatgcactgcaggtagaccgattccctatcagtcggggtacttgtatagtcacaaataagtacactgcccttttgtggacgcacgggattgtcccaagtgtacggcagccaaactacaagttctaccttggcggtagaagcataccggctccgatcaagatcacaaagcattatggtgatagtaatatagacgttatcgccaccgaaatccttgggctgaccaaaatgaactggaactcccttgacctttatagcaaacttccctctacgatcgactccagcaatcagatcgctcggattggcaaactgctctcccggtacgaaggcaagacgtacgactatcgattgtttatctagtaa

SEQ ID NO: 117 - DNA, 2094 bp, Artificial Sequence
  Description of Artificial Sequence: Synthetic polynucleotide
atgccgaagaagaaaaggaaagtggaggaccccaagaaaaagcgcaaggttggcagcgggtccctggagaacctcaccataaacataatccccttcaagcaccccagcatccaaaaagaatttggcttctataccgagaagaaggagggctatttccccattcataggaccgagttgcccaacgagctgtgggacaaccagaaagaggaagtggtgaagcacaagttctactacacgaactttgaagacacggaggattgcgttctgaagaccaaggtggacctgtatagtagcactaagtttgccaagcatctgtacacgcgattggtgtaccagtatttcattgggatagcggatgcaatccagttcaactacgtgggtgacatagaggtttggctgctggatgcgaaagccagcaccaccaaatacaatagctacaacaagtataccctgaaaatagagtttagcggtctgaccaagagccccgctctcctcctcagctatgacaacactagtaaggtagcgactacgagcatagacgaaatcaacattcccaccgagtacttcaagaccgtcgtgtataacaaagaaatccagaggttcaagtacctgaccgaggacgcgaaacaacacctcgatcaagtgtatcccctgctcaacataccgttgaaaaaccatcttgagattcctcacaccgttccccgcaagggcaacaggtataagccctactttaaccacattacgactttttacaataactatttgaacaccgacgaattcagggccatcctgccccttgatgagaatggattcttcaatatcccagaggacagcattttgaaaactagcaaaaattctaacaacctccggttctataagaaagtcggagtagatcccaaggctggaatgaagaagcccggtccctacaaggcctccccccacgacaacgtgaacctgttctttatctatcacaaacccgacgcacatgaatacgccaaaacgttgcatgactacttcatggaggggtacaaaaagttctttccccccctcaagaacgttatccggcagccgctgttcctggacaaaggcacctcacttgcatttgagagcttcgacagctgcatcgccgagctgaaaacccatctgttcgacctcaaaaaaaagcccaatacccggtacgtggccatctacgtgagccccatccataaggaggacgaagacaataaacacctgtactaccaggtcaaagaagagctgcttaaacatgacatcaccagccaggtgatttacaaagagtccatcaaagataaatacttcggcgctttcctcgagaatatcgcaccagctttgcttgcaaagatcgacggcattccctggcgactggacagggagttgaaacaggaactgatcgtaggcgtcggcgcctataaaagcagcgtcaccaacacaaggttcgttggaagcgccttttgctttaacaacaaaggagagttcaagagctttgactgcttcagggagaaggaattcgatctgattgccgggaaaatcggcaagcaggtgctcaccttcattgaggagaacgagaacaagttggagaggctgatcatccattatttcaagcctttcaacaaggatgagatagatctcgtgcaggagaccctcggcctgctgaagctggaaatccccatcatcatcgtgactatcaataagaccgagagctccgattacgtcgcttttgacaccaacgacgacgccctgatgcccctgagcggcaccattatcgagatagcacatctgaagtatctgctgttcaataacgcgaagtacagcagcatcggcttcgccaaagaccaccccttccccgttaagctcagtctgtactgcaccgaccaggattacttcgaggacatcgccatcgtcaaggagctcatagatcaggtttatcagttttctaggatgtactggaagagcgtcaagcagcaaaacctgcccgtgacaatcaaataccccgagatggtggcccaaatcttcccacactttgagggcgataaactgcctgattttggaaaaaacaatctctggtttctgtagtaa

SEQ ID NO: 118 - DNA, 1914 bp, Artificial Sequence
  Description of Artificial Sequence: Synthetic polynucleotide
atgccgaaaaagaagaggaaggttgaagatcccaagaagaaacgaaaggtggggagcggcagcgtgaggctggtaaaccagaaagagaaaccggaaggcgactacgtgtatggctacactctcccaatagaccccagtaacaggaacatgaggcagcccttctggataagcatggataaaaaggagggctatgaagctcatttcgttggcccctatgagaacattgagttgaccaagagcgtgatcttctgggaccttctgaggaggaccagggagcaactcagcagcgataagttcacggaatcaagaaaaaagttctttaaggagatctacttcccccttaacctctacaatgagggcagccaagggctcgccgtgcaaccctactacctgaagattgatcagcaatttggactgctggtggattttcaattcaaacttgacaaagatttcaccttcagccggaagattcaacagctcagtctgacattggatgggaagaaccggaggaacctcaactactacgtcgacaggataaccaaaaccaaccaattcatcaaggccctctggaacatcattggcaccttctcccataatgaaaacaaggaaaactacacgctgaggaacgacttctacccctgcgccgcaagcaggctgcggtctcgaatgtatctcttttccaatggcagtgaatccaggagccagttcaatggcttgaaggaatacggcccactccgacccctgacagccaatccgacactgctgtttgtgttccgggaacaagaccgcgacgccgcgagaaaactggcgatggcacttaaaggcagcaaaaagcaagatcaatacagcttccccgggttcaactccctgtttaaagcggacctgttgatcgacggaaatcccatggtcttgaaagacttttctatcgagagcagcagggaggtgttggccagggtgacaacatcaacatccagcttgttgcccattttcatcctgcccaaccgcgagggcgacggctacctggagcacaaagccatcttcgccgagaacggcatacctactcaagcgtgcacactccaagtcattcaggacgacgtgacccttaggtggagcgtccccaacatcgccctgcaaatattctgcaaagcgggtggctggccctggaaagtgcagagccccgtaaccgacaacgccctgattataggcataagtcagagccacaagttgaattatagtgacggtaagacaactgtggacaagcacttcgcttttagcgtgctgactgattcaagcggcctctttcagaaaattcaggtgctgagcgagcagaagacggaggagacctacttcgaacaactgaagctgaatctcaaaagcatcctgaacgccaatagcaagaactaccaacgcatcgtgatccacacctcatttaagctcaaatacaaagaaataagtgcaatcgaggaagttgttagcgaatttgcaaggaacagcaacagcgccgactgcaagttcgccgttgtgaaggttaatcacaagcataggtacttcgggtttaatcgggaagtgaatagcttggtgccctacgagggaaccgtgtgtaagctgggcgatagagagtacctggtctggttcgagggtatctatcaggagaagccgaccgttaccaaagcatttccgggtcccacccacatcgaatttcttaaaatcgggtctaataacgtgattagcgacgaccttttgttgcaagacctgatgaacttgagcggagcgaactggagaggctttaatgcgaagagtgctccggtatccatcttttactgccacctggtggccgacatcgtgcatgatttccaaatcaaaggcctccctatgcccgccatagatcttatacgaccctggttcatctagtaa

SEQ ID NO: 119 - DNA, 2343 bp, Artificial Sequence
  Description of Artificial Sequence: Synthetic polynucleotide
atgccaaagaaaaaacgaaaagtagaagaccctaaaaagaagcggaaagtagggtcaggctctatgcttcaactgaacggctttagcatcgaaatcgccggaggttccctgactgtcttgaaatctaaaatcgcgcctaccgacgttaaagaaacccgcaggagcctggaagacgactggttcaccatgtatcacgagggccacttgtactcacttgcaaaaaacagcaacgcatccggcggattgggtgagaccgagctcctggtcctgtctgatcatctgggtcttaggttcgttaaggctatgttggaccaagccatgaggggcgtattcgaggcctacgaccccgttagagataggcccttcacatttctggcgcgaaacgtagatctcgtagccctcgcggcagaaaacctcgagtccaagcccagccttctctccaaattcgagatcaggcccaagtacgaactggaggccaaggtagtggaattcagaccgggcgagctggaacttatgctggcgctcaatctgactacacggtggatctgcaacgcctccgtagacgagctcattgagaagaacataccggtccgaggaatgcacctgatccgacggaaccgggagccgggacagagaagcttggttggcaccttcgaccgcatggaaggcgacaacgccctgctgcaggatgcttacgacggacaagacaagatagcagcctcacaggtgaggatcgaggggagcaaggaagtcttcgcgacctctctgaggaggctcttgggcaatcgctataccagtttcatgcactccgtggataacgagtacggcaagttgtgcgggggtttggggttcgacggcgaacttaggaagatgcagggatttctcgcgaaaaagagtcctatacaactgcacggaggtgtagaagtgtccgtggggcagagggtacaacttaccaatcagcctgggtataagacaacagttgagcttttgcagtcaaagtactgctttgacagaagtaggacgaagctccacccctacgcctgggacgggcttgctcgattcggcccattcgacaggggcagcttcccgacgcgatcccccaggattctgctcgtgacacccgactccgcgagcggtaaggtctctcaagctctgaagaaattccgcgacgggttcggcagcagccagagcagcatgtatgacggcttcctcgacacctttcacctcagtaatgctcctttcttcccccttcccgtgaagctggacggcgtgcagcgcagcgacgtgggcaaagcttatcgaaaggcgatcgaagataaactcgcacgagacgacgacttcgacgccgcctttaacattctcctggacgagcacgccaatctgccggacagccataacccctatctggtcgccaagtccatcctcctctcccacggcatcccagtgcaagaagcacgagtgagcactctgacggccaacgaatacagcctgcaacacaccttcaggaatgtcgccacagccctgtacgccaaaatgggtggtgtcccatggaccgttgaccacggggagaccgtggacgatgagctggtagtaggaatcggaaacgcggagcttagcgggagcaggttcgagaaaagacagaggcacatcggaatcacgacagtgtttaggggggacggcaactacctgcttagcaacctcagcaaagagtgccgatacgaggattacccggacgtactccgggagagtaccatcgccgtgttgagggaggttaagcaaaggaacaattggttgccgggtcaaaccgtgcgaatcgttttccacgccttcaagcctctgaaaaacgtggagattgccgacatcatcgcgagctctgtaaaggaggtaggctccgaacagaccatagaatttgcattcttgaatgtttccctcgaccactccttcacccttctggacatggctcaaaggggaataacgaagaagaatcagaccaaggggatatacgttcccaggaggggcatgacagtccaggttgggcgctacaccaggcttgtaaccagcatcggtccgcacatggtaaaaagggcaaaccttgccctcccgcgacccctgttgattcacctgcacaagcagagcacctatcgggacctgagctatctgagcgaacaggttctgaactttaccaccctgtcctggaggagcaccctccccagcgagaagcctgttaccattctctactcatcactgatagccgacttgttgggaaggctcaagtcagtggatgattggagccccgcagtgttgaataccaaactgaggaatagcaaatggttcctgtagtaa

SEQ ID NO: 120 - DNA, 2061 bp, Artificial Sequence
  Description of Artificial Sequence: Synthetic polynucleotide
atgccgaagaaaaagaggaaggttgaagaccccaaaaagaaacgcaaagtgggcagcggaagcatgtccggccttttcctgaacttttaccaggtagacatccccaccaaatccgtaccgatccacagcgtagagtatagccattacagttcaaaggaggcctttatcgcgttgaaagaaaacttcccctactttagcttctaccgggatgacgaccgaatactgatctggaagaaagacaaggatgccgagctccccgagaagaactcattgattgaaattgatttcaccgagaaagcgaaggtcctcagcaaaatactcgagagggccatcattgacttcatcgagccaaagggctacaagatattcaagaacaagtacagcaacagctgggaaatagtgagcatgaaggacatcctgaatggtgggatcgagggactcagcatcaatcgaatcgtgcatttttccccctgcttcttcttcaaggagaacaaactcatgctgggtttcagccttagcacaagcctcaaaaacgtgtttacctggaataaggcggacttcgaaaggtacggctttgacatcaagggccttaaaggagacgaagagcggatttttgccaacaagcaatcccttaagaggttcctggagaccaagggcgcagttgcaatgtatgaccaaattatcgcaaaggaaaacaagaacgcgaaaatgtttagcatcatcgacggcttctatcggtggctggagaggaacaagactgaaatccagcttccattcggactgaagataaattcagtgtctaaaaagtacctgccgttcgaggatgagctgatcaagagcgagatcatccctaagccccaaaggtatttctatagcaataggaagaacacccagagcctgcggtactatgacgagatggtgaagacttatcagccctactctctggagctctaccaaaacaaacagatcaacatcggaatcatctgccccagcgagtaccagggagagacggaggggttcataaagaagatcgaactgaagctcaaggaagtattccatttcaacagcctgatctttcacttcaagaccattacgaacaaggacctcgcgtcctataaggaggttttgtacgacgatgaactgctgaagtgcgacctgatttacgtcatcgtgaatgaggcccaggagaaactctcacctaataactccccttactacgtgtgcaaggccaagtttataggcaatggcatacctacgcaagacattcagattgagaccatccggcagaacttgaatgcgttcacaatgacgaacatctcacttaacagctacgccaaactgggaggcaccgcgtggaccatcgagaaggaagacaaacttaaggacgagctggtcattggcatcggctccaccctgtcagaaaacggccagttcgtgctcggtatcgcacaaatcttccataatgacgggcgctacatggcgggtgactgcagccccctttctaccttctccaactacgcggagaacctggaggatcacctgtacaagaccctgaagcccctggtggaggagatgagcaaaagcggcaccttccggctgattttccacttgtttaaaagtgcctctgaggagtacgagatacgcgcgatcaacggcctgcagaagaggctggcgaactacaatttcgaatttgcactcgttcacctggcctatggacacaacttccgactctactacaacgacggcaacggcgacattaatcagggcacatatatacaactgtcaaaacacagcgccctgctccacttcgttagcaagtcagacttgcccctgaaaatcgacctggacaagcggtctactttcaccagcctgttttacatcgccaagcaggtgtactggttcagccatctgagtcatcgcagctatatgcccagtaagaggaccgtgaccatcatgtatccgtcaatcatggcgaagatgaccgaggagcttaagaaggtggaaggatgggactacgagcgcctgaaagcagtaagcgataagctgtggttcatctagtaa

SEQ ID NO: 121 - DNA, 2280 bp, Artificial Sequence
  Description of Artificial Sequence: Synthetic polynucleotide
atgccgaagaaaaaaaggaaggtggaggacccaaagaagaaacggaaagttggcagcggctccatgagcgtggcgatcgtgagcccccaaatgtacaagagtctgagcgaggtgtttcctctgaccgcctcccaactgaactttatgtgctttaggctgactcccgaaatcgaaaagaaggatggtaataggctcagctaccatttcagtctgaagctgccggaaactgttgtgatctggcaccagccctacttctgggtgttggcgagtagtaacaggcaaatccccaataaggacgagttgcaagaaactctgataaggatccaaaacgaggtggatgacttcaaagaacgactcttcggtttccagagcgttcgccacccccaactcaccccctttatcatcagcctcttcgccgtgcaggtcctcaaaaaaacaaagttcgactaccccattgcattcagcaacaacggtgtaatcgtcaggagggagcccgacttttggacggagagcatagagcttcaagacagcctgcatcctgccctcacgctgaccgtaagttcatcaatagtgttccgcgacaacctcgcggagttctatgaaaaacatcatcaaagggagaagcccgagcagtttctgatcggcctgaaggtgcaggaaatagagaggggcaacaatgcgatcatcgtgggactcgtcggcaccatcggcgagcaccgggaccagctgcttgaaaaagcaaccgggagcactagcaagcaggcgctgcgagaggcaccggacaaccagccggtggttgcgatacagttcggcaaggatacgaagcagttctactacgcaatggccgcgttgcggccgtgcgtaacctcagagacggcaaaccagttcgaggtagagtacggtaagctcctgaaagctacaaagataagccaccaggagcgaaccaacctgctggcctcatacaagaagacggcccaggagtcattggccgcttatggcatccgcctggagctgagtgtgaatagcagggattaccccagcttcttctggcaaccccccgtgaagatcgaagataccaaacttctgtttggcaacggcataaccggcaagcggactgaggtgctcaaggggctttctatagggggcgtgtaccgacgccacgggaaattccaggacaagtcaaaagtgatccagatcgcggctcttaagctttgcgacgtgaccgttagcttgttcctgaagcaacttactcaaaggctggcaaaatacggcttccgaagcgagataatcaccaagaagcctctgtcaatcaagaaccttgccaccgccgaagccagggctgctgttgagaaagcggtcaatgagctcgtggaaataccccacgacatcgtgcttgccttcctgcctgagtccgacaggcacaccgacgacacggatgagggttccttctatcaccagatctactcccttctcctcagaagacaaatagcctcacaaattatctacgaggacaccctgtccaactctgggaactaccagtacatcctgaaccaggtcattccggggatcttggcgaaactcgggaatctgcccttcattttggcggaaagcctcgatatagcggaccacttcatcggacttgacatcagcagaatctctaagaaaacgcaggtcgggacacgaaacgcgtgcgccagcgtgcgactttacggacgccagggtgaatttatccgctaccggcttgaagacgacctgatcgacggcgaggcgattccacccaagctgctggaaaggttgctgcctgcgaccgagcttgcgaataaaaccatactgatctacagggacgggagcttcgtgggcaaagaggccgactatcttgtggagcgagccaaggcgatagacgcgaagtttatcctcgtcgagtgtaagaaatccggcgtgccgcgcttgtataacttggagcaaaagaccgtgatcgcgccgagtcagggactggctcttcgactgagcagtagggaagcaatactcgtgaccaccaaggtgcccgataaagtgggcctggctagacccatccggctcacaatccacgaaaagggccatcaagtaagcatcgaatccgtgctggacactacactcaagcttactcttcttcaccatggcgcgctgaaagaaccgcgactgcccatgcccctgtatgggagcgacaggatggcatacctccggctgcaggggatacggcctagcgttatggagggcgaccgccaattctggctgtagtaa

SEQ ID NO: 122 - DNA, 2337 bp, Artificial Sequence
  Description of Artificial Sequence: Synthetic polynucleotide
atgcccaagaaaaagagaaaggtggaggacccaaagaagaaacggaaagttggctctgggtcaatgaacctgaccgtaaacctcgcccccatcagcgtgcagggcgactgctcagtcctgattggcagacagcgctacgacgagcagaggctggctgaacttaggtcagactttcggggcacccacgtgtttcggcgagacggtccagatagcatgattgacatccccgtggtccccgacgcggcacctctgggcaacctgagggagacgatcgaccttaggcggtaccagcggctgtggcccatgcttctgcaggagtccctcatccagctgcttggtaagcgccccatccagtccagcaagcccttgaagttcctgggagctaggtctcctctgatcgagcacccggatctccctgagtggttgaggcgggtgagcgttaccgagatccacacccgacacatcaccgtggacggcaagcaaatctacggtatcgtgtgcgatgtgagggccaagtcttttatcctcgccacctgcagcgaacttctgaaattcggcgtgaccatccttggtagatacgtccaaatagaacagcccgcgatagacgagagaaccatgcctaaaaggaagctcatcggcagggtaaggtccatccaaggggatgatctgcttcttgacgactgtgaggccggcttcgaaaaagtcgctgcgaatgaggcatttctcgagccgcggaaggaaaatttcgaggactgcgtgaggcaggtgctgaagcgggacgccgagagggtgttggagaggtcagctcgcgccagccaaaacctggccgcaggccctgggaaactggaacacatcgacggaatcatcaggtatcttagggagaagaagcccgcagcggtgcccggctgccatttcgtgatcgatgccatgctcaacacaaacggccacatttttccacccggggaaacaatggacaaacccttcctcttgttcgaccctagcggttcacggagagaagactggcccgagaagggccttaaagatcacggcccctatgatgagcaggtgttttcccccaagtccctgaagatcgctgttgtgtgccaaagccggttggagggcagagtggacgagtttctggcgaagtttctcaatgggatgccgaaggtctttcaacccggcaagagcttcgcccgctacggcgacggattcgtgaaacgattcagactgaacaagcccgaggtgcacttctttcttgcagatggcaactccgacgaggcatacgccgtggccagccgcgaggcactcgataaagcgagggatagcgggttcgagtgggacctggcgattgtgcaaattgaggaggagttcaagtcactggccgacggctccaatccctactacaccactaagagcatcttcttgcggagggacgttccggtgcagagcgtcaggctggagaccatgagcctgtcagataatgacctggtgttccccatgaaccacctgagcctcgctacctacgccaagctggggggcacgccctggctcctggctagctcacaaaccgtggcgcacgaactggtgatcggactgggtagcagcaccagctccgaatcaaggctgggcagccagatgagacatgtgggaatcaccaccgtgttcagcagtgacggcagctacctgctttctgatagaaccgccgcagtgcccttcgagcagtacccacaagagttgaggaaaacgttgcgaaaaacaatcgaggccgtcagggccgaggacaattggcggagtagcgacaaggtgaggttggtattccattcattcaagccgttcaaggacagcgaggtagaagccatagaggcgctgaccaccgacctgggcctgggcgacgtgaaggccgcctttctgcacattgcgcccgaccacccgttccttatcttcgaccacgaccaaatgggcatcgccgcacgagggggcaaaaaaggcgtgttgggccctgctaggcagttgcacatccggcttagcgacgctgagagccttgtggtcttcgcaggggccagcgagcttaaacaggtgacggatggtatgccgcgacccgcgctgctcaagctgcaccccaaaagcaccttcaaagatatgacctacctggcaaggcaggcctttgcctttagtgcccatagctggcggatgctgtcccccgaacctttcccaattactatccgctacagcgacctgatcgccgaccgcctggcgggactcgcgtctgttaagggctgggaccccgatgccgtgacgttcggcgctatcggtcacaagccttggttcttgtagtaa

SEQ ID NO: 123 - DNA, 2370 bp, Artificial Sequence
  Description of Artificial Sequence: Synthetic polynucleotide
atgcccaaaaagaagcgaaaagtagaggatccaaagaaaaagcggaaggtcgggagcggctccatggcgtttaggcccggtgaacgagtcagaccgcagctcgcgctgaatgcgatcagggtccttacaccccctggcaccatccccgccagtgtagtccaattcgacagagcgctgctgcacgcatatcttgacagacccgagaacgacgtattcgctacccgacacggggagactgatatggcggtcgtacccctgaccagcggtgcgaacctgccaacggacagaatggggcttccagctgcagagcacctcaggctggtatctgcgctgacaagagaagctgtgtttcgcctcctcgcggccagcccggaagcggatctgctgatccggcgacgcccaccgaccgtcgcggggaagagagaaaacgtacttgcagaggacattgggctcccggactggttgaagaaaagacttgtgctggagttcgacacgcgcatattgcaaccaccgagaggggacgcctacgtggtgctgacgtgtagtaaaaggctgcgcacgacaatagacgcgagttgtcgcacccttctggaactcggtgtaccactgacgggtgccgcagtcagctcctggagggaagatcctgaccccaaggtgagccggcgattggcctacgctgggcgcgttgtagaagtagggcaggacacgctcactctggacgaccacggagctggtccgagtgttgtctccagcgaagacgtgttcctcgagccgactcgagcaaacttcaacaaggtggtggaagtgataacccagggtaactccgaacgagccttcaaggccgtacaaaaagcagaagccgaatggcacggcgggaggcggacaatcgaaatagtgcatggtgtcctcaaccaactcggcaaccggtcaatggttcttgccgatggcgtgcctctgcggctcgggggcttgatagaccaagcggtcgatagcgacgcattccccccagccgaggcggtgtggcgccctaagctctcattcgaccccgtgcacagccccgagacatcaaattcctggaaacagcagtcactggacaggacgggccctttcgataggcaaacctttgaaacaaagagaccgcgaatcgcggttgtccatcaggccggaagaagggaggaagtggctgcggcgatgcgcgatttcctccacggaaggcctgacatcgccagcgatacgggcctggttccccacggttcaggactcctcggacgctttaggctccacgaacccgaagtgagatactttgaggccgcaggcagggggggacccgcttatgccgacgcagcacggagtgcgctcagggacgcggcgtcaagggacgaaccatgggacctcgcaatggtgcaggtagagcgggcgtggcaagatcgcccacatgccgatagcccgtactggatgagcaaggcaacgtttctcaagagggatgtgccggtgcaagcccttagcacagaaatgttgggtcttgatgcatttgggtacgcgaacgcacttgcgaacatgtcacttgcaacgtatgcgaaactgggcggtgccccgtggcttttgtttgccaggtcaccaaccgaccatgaactggtggtcgggctcggaagccacactgtaaaagagggccgaaggggtgcgggtgagaggtttgtcggtatcgcgaccgtattcagcagccagggccattatttcttggatgccaggacagccgcggtcccgtttgaagcctatcctgctgccttgagcgacagcatcgttgacgcgatcaaaaggattggacgagaggaagcctggcgaccaggcgaggccgtcaggttggtctttcacgccttcacccagttgagccgagaaaccgttcaggcagtggagagagcagtagcaggcatcggggccaccaacgtaagcttcgcgtttctgcacgttgtcgaagatcacccgtttaccatgtttgaccgagcgtggccagacggaaaggcgacattcgcccctgaaagaggtcaggcgcttcgactctccgagcgcgaatggttgttgacacttaccggcaggcgcgaagttaagagcgccagtcacgggctgcctgggccggttctgttgcgacttcatgacagcagcacctatagagacatgcccgtgctcgtccgacaagcatccgacttcgccttccactcttggcgcagttttggacccagcggactccccatcccgttggtttacgcggacgaaattgcaaaacagctcagcggcttggaaagaacccccggatgggacacggatgcggctgagggtggccgggttatgagaaagccttggtttctgtagtaa

SEQ ID NO: 124 - DNA, 2358 bp, Artificial Sequence
  Description of Artificial Sequence: Synthetic polynucleotide
atgcctaagaaaaagcgcaaggttgaggacccgaaaaagaagaggaaggtcggcagcgggagcatgcagctgaactacttccccataaagtttgagtttgaagagtaccagataaaaactgagccctacagcgaagaacgacttaaagagttgagggccagttacaacgccacccactccttttttagaaatggagacaatatatgcattagcaacaaggaaggcgaggacattagtctgaccggcgaggtgataccgaaaagaattttcgacgacagtcaagtgaccgcctcattgataaagcacttgtttttcaggacgttcaaggagaggttccccaactatattcctgtggacttttaccccttccgcttcttctccgcccaggctaaagacgacatcatctataacgccctgcccggcaacctccggaaacgaatcgcttacaaaaagctgatcgaggttcagttgcggctgacggaaataaacggcatcaagcagtttggcttcctgatcaacattaaacgaaattgggtgttcaacaagtcatgcttcgagctccactccgagggctacaacctgatcggggtggacgtgctgtacgccgaggaactgccggggttgaccgaggtgctggccccaaacgaagagcttttgggcgtaatcgcggaaatcgtggacgacaatgccaggatagaaaccaacgagggcattaaggagttccctctgaaccagttgttcatcaagaaaagcaagtacaacattggcaattaccttagcttcgcgatctctcagcaaaagagcgacgaaataatgaatcttatcgagagcaaacgctccgacatctacaataccaagggtctttacgacgagatcttgaaaattgcgaaccatcttttttgcgagaacagcgcacccatactgtttcataataaggacggattctgctttactgtcgattcccagccgctcagtgtgacgaacagcatggaattgaagactccaacattcatatacgatccagcggccacgaagacgaattctagcaatcccgacttgggcctgtccaattacgggccctacgactccagcatttttgacataaagatacccaacgtgttgtgcatctgcaataggaataatcgaggcaactttacaaagtttctgtctaacctgaaagacgggatacctcaaagccgctatttccagaaaggcctccagaagaaatacgacctccaggatgtgatcctcaatatccgagaaatccaggcctatagcatcgccgactaccttaacgccatcagggactacgatgagaacaagcctcatctggcgatcatcgagatccctgccagcttcaagaggcaggccgacgtggcgaacccctactaccaaattaaggccaagttgttgagcctggagattcccgtgcaattcgttaccagcgagaccatcggtaaccacaacgagtatatcctgaactctatcgcgctgcagatctacgcaaagctcggcgggaccccgtgggtcctgccctctcaacgcagcgttgacaaagagataatcatcggaataggccattcctggcttaggcgcaaccagtacgctggcgcagaacagaatagggtagtggggatcacgacctttatgagctccgatggccagtaccttctgggtgacaaggtcaaagatgttgccttcgagaactattttgaggagcttctgaaaagcctgaagcaaagcatccagaggctcagcacagagcagggctggagcgatggcgacaccgtgaggctgatattccacatattcaaaccgataaagaacactgaattcgacgtgatcagtcagcttgtcagagacatcacgcagtacaagattaagttcgcattcgtaaccatcagcactgtgcacccttccatgttgttcgacattaatcagtccggtatcgccaaatacggttccaatatcatgaagggacaatacataccaaacaggggcagcaacgttttcctggacgagaagacatgcatcgtacagatgttcggcgcgaacgaactgaaaacggccaagcaaggcatgagcaagcccatccttataaacattcgcaccccccaggggaactacaattcaagcgacctgaacgatctcctgttttatgacctggggtacatcacacaacagatatttagctttacctacctcagctggcggtccttcttgcccggtgaagagccggcgactatgaagtacagtaacctcatttccaaacttctcgggaagatgcggaacatccctaactgggacgccgacaatcttaactacggcctgaaacggaaaaagtggttcctgtagtaa

SEQ ID NO: 125 - DNA, 2274 bp, Artificial Sequence
  Description of Artificial Sequence: Synthetic polynucleotide
atgcccaaaaagaagaggaaagtggaggatccaaagaaaaagagaaaggtgggtagcggaagcatgaccgaggccttcctcacaaccaggaggggcttcgtgcaaaagctgacgctgaccaggtacgattacctgaactggatcatcgagtccgaggcgcagaaagccaagctgaagaactggcttaagaacaagagcgggtttctgacccacgagatcgaggatacctgtttcttcaccttcgagaggcttctggaggagagtactaagcagtatagagcctccggcgagaaaactctgtctgccccgttcaagaacacgcaactgatctcaaatctgatcggtaccatattgaaaaaggagttgagcaagaaatacaagcaattctttagtcaaaacatcttcatcgtgagcaccatcgatctgtatccattcaatctcttgaaggcgttcgagttcaacatcgaagtgtttgacagcggccacttccttatccacgtcaacccagtgtctaaaattgtaagcagcaaggttgtggacaaggagtatctggactacctcaagaaaagcaacctcaacaacagcaaaaccaccgagatggagttcgcggtgatcaaccatgaaaggaatttcagacttaaattcgacctgcttgacgaatgcatctttgagaagatagagaagctgcacagcgagaagaatatgtttacagccacttttgattaccatttcctggccaacttcagccccgagatcttcggcaaaatcgtggaacatactagcaaggatctgaagcaggccatcatgttcctgaatgacatactgagcaatatcaagctgccgagctttctcaacctgcacgaggaacgatactttaaggtcaatatctccgaattggaccgaaagaataatcttctgattggaagcagtttcgaggtaataaccatatactcaaaaagccagacccagtatggactgaggattgagttcactcgcgacagcataagccgggacgagcttataacaatctttctgaaaaacgaagagctgatcgagaaactcaacgacattaaagtggtccccgccaccatcaacgcaaaaatcgaacagaagaccggctggaaaaacccctacatcaccaatgttttcatcgataacgtgggtgccttcagcaccagcagcctgcaaagcgcctcatacttccacggcatctacaaggccgttaacaactggaatatcctgcccatcgtgtacgaggacctcgacatcaaagtattcgagaacctgatgctgcacgcctttaacaagaacgccaccgaattcaagatcctggaacccatcataatcaagtccacgaacgaaatcgacaaacaggaggtgcagaggagcatcaaaaaccaggccggcaagaccatgatcgcagtgttctgcaagtacaagataccccatgacagcttcgcccccctcaagggcttcaagtatcagatctatcaaggcgacaccacggacaataagcagaatagggccaaactgagtaacttcacgtgcaagtgcctggagaaaatgggaggggtgattgcggcaatcgcggacacaagcatagccgaggatggatatttcattggcatcgaccttggccacaccacaaatggcaaggaaaagttctccaacctcggagtgagcttgtttgatagcctgggcatcctgttgggcgattacgtggagaaggagattccaagaagggaaaacctcatcgacacgaactgcctcaatgcttttaagaaacttgacaaaatgctggaagctaaaaaactgaacaagcccaaacacctgatcatccatcgggacggcaaactgcacttcaaggatatcaacattctcgtaagctgcgtggaaaccgtgtggggtaagataaacgtcgatatagtcgagatcattaagagtggcttccccgtgatggctataaaggacgagaccaacaaaccaatcaatcccataagcgggaccagctaccaggacgacatccataagtacgccatactcgccacaaacgtacaagccgacgaacagtcagccgtaataaacccgataatcataaaacacaaatacggagagctggagtttagcaaaatagttgaacaggtgtactggttcacgaaagtgtataccaataacctgtacaatagtaccaggctcccagcgactacactcaaggccaacaacgtggttggcacgtctaagaagctccacagaagtacatacttgggctagtaa

SEQ ID NO: 126 - DNA, 2157 bp, Artificial Sequence
  Description of Artificial Sequence: Synthetic polynucleotide
atgcccaaaaagaaacggaaggtggaggaccctaagaaaaaacgaaaggtcggaagtggcagcgttccagtgtaccttaatcggttcctgctggaccacctcacatcacccttgtccttgccggcgtttcgggtcgaactggaccctcccccttccaaagatgaagtgcacccgctcctggctctcgtcggtcgggaagcgggagggctcgtgaggttccagaacaggctgatcggctgggaggctccacgggccctcgaaggtcaggttaggcgaggcaagcagtcatatagactggtgccccttggccggcaggcactcaatcttagaaaacccgaagaaaggcaggcgctcgagaatttgtataggatccgactggaaaacatcttgaaagccctcgccaaacgacatagggctagagtcgaacgcaggggcaacggcctttttctgtggaggccagagaatccccgagaggagaaggaggggtggcacctttaccggggaagcctgtaccgcatacatctctatcctgacggcgaagtgatacttgaagtcgacgtgcagcatcgatttcaacccactctccatctcgaggagtggctgcaacgaggctatccactccctaggcgcgtgactaacgcctacgaggacgagaaagaatgggcactcctgggcatcgaagaggggaaggatccccgctcttttctcttggatgggggcgagtcattgcttgactaccatcgcaagaagggacgattggcagaggggcaggaccccggtcgagtggtctgggttgctagaggtaaagaacgcgagcggatcccacatctgagcgtcttgttgaagccagtcatcaccatggagctgctggcggaagtcgctgaggtcacgcaggaggccttgcctgcgcttcagctcgaacccgaggaacggctgaaggacattaggcgcttcgctgaacctgtactgcaagcgttcggcaaacgcgaaactgcaaaaccccttgaaggcagagcccagcgattgccgcgacccagtttgttggcacggggaaaaaagcgagtgggcaaagtagcggacgtactcgaaaagggagcattgtcaccgggcgagacacggttggccctgctcgcatgggagggagacgggaaggccaaaggcggtctcgcgtacttggaggagaggcttcagggcgtcgggtctgcatccggcatcaaacttgaacttaaacggcgatttctgccccgaggcgataacctcgaaatggcacaggtgtttgaggagctctcccaggaaggagtaggtgccggtctgcttctgactccgcgcctcacagaaggggaaagacgcgaactgaaaaatactgcggcgagccatgggctcgctctccaactccttaacccgtttgaccctggcgacatctacagggtgaataacgctctgcttggatttctcgcgaaggccgggtggctgttcctgagactggagggaacttatccggccgacctggtggtggcctatgacgcaggcggggagagtctccgattcggcggagcctgcttcgcccacctgactgatggcacgcatctggggttcagtctgccagccgctcagggtggtgaacggatggccgaggaggtcgcgtgggagttgctgcgacccctgctgttgagataccggaaagcgaagggccagacaccagggaggatctttctgctccgcgacggtaagattcaaaaggaagagttccgaaaagtggaagaggaactgagaaagcgcaatattccctacgcgctgtttagcgtccggaagacgggggctccccgactgttcagcaaaaatgggccgctcggtgacggtctttttttgcgactgccagaggaggagggcgggtttctgttgcttagcgccgagggtgggaagggcaccccacggccggttaagtatgtgttggaggcgggagaagtggacctcaacctggaggaagctgccaggcaattgtatcacctgagtcgcatctacccgggctccggttaccgattccccaggctgcccgcaccgttgcatatggttgataggatggtgagggaggttgcacggctcggcggcagccataacttgagactcaaagaagaacaactgtttttcctgtagtaa

SEQ ID NO: 127 - DNA, 2253 bp, Artificial Sequence
  Description of Artificial Sequence: Synthetic polynucleotide
atgccgaagaagaaacgaaaggtggaggacccaaaaaagaagcggaaagtggggagtggcagcatgttcgtggaactgaacgccttccccatcgacatccgcaatatcggtatcgtggaggcctgcgaggtgccgtacgacaaggaggtgctttatagcctgcatgataacccacaaaaagattaccatgctatcagaaacggcaaccagatattgatattttctaatagcaaaaactaccccatccagggtacaatcaaggagataaatcttgcacaggactaccgcatcctgtttttccttattaaggagtccattatcaagatcctgacgcagatcaaacgggagcctttcaagttcaacccgattgagttcatctcaccaaaggagaacatcaccgagaatatcctgggaatcaattacccatttcaaataaacgccaaatattcaatcgataccagaatcattcagggggtgccctgcctcaccattgattgcagcacgaagaaatacaacaaggaatccctgatctacttcattaacgacggcttcaacctgattaacaggtacgtgatctcaaagcaaaacgagaagtataagcgcgtaggtaagatactgagcattgacaacaacatcgtgactgttcagagctgcgacaagataaagaagtactccgccgaggaaatcaccttggaggcgaactctaagaacaccaaggactatctggcatacaagttcccctataagttcgagcagatccaagaaagcattaagaaggcgatcagtaccttcacccaggggacctctaagcagataaacattggcaagatctgggactttttcagccagaaaggcatcttcctgttcaacggccaccgaattaacatagggctgcctcccgacatctcccagcaatgcaagaaccttgtgtacccgcgctttttctttagcaactcccgagaaaacaattccaaagagaacggcctgaaggattatggcccttacaccaggaattactttgacaggaataaccccagcatttgcgtgatttgcaacgctaaggaacaaggcaaagtggaacagttcctgcacaaatttctgaagggcatacccaatagccataactttaagacgggcttcgagggcaagtttcatattggcctctctcagatagaatttttcacgaccagcgacgacagcctgggcagctaccagttggctatccagaaggcaatccaaacgaggactaaccaaaactctagccagtgggacctggccctggtgcaaaccaggcagtccttcaagaaattgttggtggagcagaatccgtactttattagcaagaaaatgttctttcagcatcagatccccgttcaagacttcaccatcgagctgaccaatcagaacgacaaaaacctggagtattctctgaataacatggctctggcgtgctatgcgaagatgaatggaaagccctggctgcttaaatcaagccctactatcagtcatgagctggttattggcatcgggagcagcaacatcatcatcgaggaggacagtctgaaccagaggatcatgggcatcaccaccgtgttcagcggcgacgggtcttacatggtctcaaacactagcaaggcggtggcgcccaatgagtactgttgcgccctcatagacacacttgagcaaacgatcaagaagctggagaaacttatgaactggcagagcaatgacaccattaggctcatctttcatgccgccgtgaagaccttcaacaaaaatgaaatcctcgccgtaaaggaagtgatcaaaaagtatagtgagtacaagatcgagtacgcttttctcaaaatcagcagcgaccacggtctgcacctgttcgaccactcaactaagaatgagaataagggtaaattggctcccaagaggggtaagtattttgaactgagtagccatgaaattttgctgtacctcgtggggcagaaagagctgaagcaggtgagcgatggccacccccagggcgtgatcgtgtccctgcataaggacagcagctttcaggaccttaagtacctctctaatcagattttcagttttagctcccacagttggaggagctactttccctctcccctgcccgtgacaattcattatagcgatctcatcgcggagaacctgggctggcttaacaagctgagcggctgggacgatacaatcctgctgggcaaacttggacagacccagtggtttctgtagtaa

SEQ ID NO: 128 - DNA, 2313 bp, Artificial Sequence
  Description of Artificial Sequence: Synthetic polynucleotide
atgcccaagaaaaagagaaaggtcgaggacccgaagaagaagcgaaaggtaggaagcggtagcatgaaaagcaacttcttccccatccagttcaacttcgacgacttccatatccagaggcttccctaccagaaggaggtgctggacaagcttcggcaacaacacaatgcgacccatagctttttccgcagagacgattttatctatattagcccaggggtagaggccgcagcgaacctgggagacgtagtacgcctctctattaccaagcaccccgaggtcgttgcttctcttgttaggcacatattctttaggacaatcaaggataaggtccccggtctgctgccaagctttcacccattcacctttcccgccaaacaggacaaatacgatctggccctgaacatgctccccgagcgcctgcagaatgttatcacctacaagaggataaccgaggtacagcttcgattcaacgagaccgaagagcaaccccagttcgtcgccgtagttaaccacaggtaccagtggactatcgaccgaacttgcgagcaattggtaaacgagggtctggacatccttggcctggaggtgaactctagtacgagccctgattattcagacggagttgtggcaccagagctgacactgttgggcagggtgatggccgtgaacggggatcacgccacagtagggaccaaccagggtccgacagagtatgccctgttcgaattgaccttgttcaagtccaaggagaacatagtgaactaccttggatctttggtgggcgagggtaaagccgaacaaatagtcaaccatatcaaacaagatgaaagcagaaggctgcaaccggacgttgtgatgagggagatcgaggaaatgggagtgtggctgtctaggctggcctacagaaactttgactccttttgcttcaccatcggaacgaacaacgctgtcagcggccaagcaggtatcagactggaggagccaaagctgatatttgacgtctcaggtacgaacatacacgctacccccacaaccgggctcaacaccttcggcccctatagtagaagcacgagtttcgacgttaactctccgaagattctggttgtgtttcaccagcggaacgcaggccacttcgcagagtttctcgcacagctgaagggcggcatcgctcagcacgcatactttgctaacgggatggtcaggaagtatggtctcacggcaatggagtaccggattgccgagatcactgactacaccgtgccccaatatcttaccgccatcaataagctgcttagggcggagaacggaagctttgacatcgccatcgtggagacctgtgaggatttccggaggctgcctcccatggataatccgtattttcaggttaagagtttgttgtacagccatggaatcagcacccaattcatcagagcggaaaccgctcagaaaccgatttattcaatagatagcatcgcgctccaaatgtacgccaaattgggcggaacaccatggacggtgccaatagggccgagcgtagatcacgaattggtgataggcatcggtagctccatattgcgcagcaaccagtatgcaggtgcaacccaagctcgaatagtggggatttctaccttcttcagcgccgacgggaagtacataagcaatagaaagacccaggacgtgccttacgatcagtacttcgatgagctcttgcataaccttaaagtctccatcgacgagatttccaataactacagctggagctcaggcgaccgcatcaggatcatattccacatcttcaagcccataaaacacatcgaggcagacgtcgtcgcaagcctgatggaacagtaccaggagttcgatataaagttcgcttttgtgacctttagcgagttccacccgtatgtgctgtttaatgaaaatgaaaggggggaatttgatgcgtataggaaggtttacaagggcacccatgtaccgtggcgcggttacaatgttctgctggatcctcggtcatgcctggtccagatgctgggaccccatgagatgaagaccagccggcacggcgcttctaggcccgtccttgtgagaatccaccgcagttctacgtttgtagacctcgcgtacgtcgtgcaacaggcctttaagtttactaggctctcattccgcacgttctaccctgtgcatagccctgtgacgctgctctacagtaatatgttggcccgacagctcaaggacctgaggggcattccgggttggaactacgatgtagctagcaggcagttgaggcacaagaaatggttcctgtagtaa

SEQ ID NO: 129 - DNA, 2322 bp, Artificial Sequence
  Description of Artificial Sequence: Synthetic polynucleotide
atgccgaagaagaagcgaaaggtcgaggatcccaaaaagaaacggaaggttggctccgggtctatgggcaggcaactccaactgaactttaccccgctcagggttaggggcgacgccatcagacttcaggcgctgcctttcgaggacgctcaacaatttaggaatctgcgcgatgagcatcgagcacactacgctgtgacgagaaggagcgaccacatcgtggccctcccacttacactgaatgcctccccaatcggcgaggagaagatcgtgagcgttgtggagcatgcgagtttgattcggcccctgcttgaacagaggttggtgacccttctgtccagtaaccggaggccggtggcccggtataatccgatcaccaccattggaagaaccttgccaacgggcttcatagaagccgaccgacacctccatttgcagtcccgcgtgcttattgctatccgctccctcaagctgccggacgccgagcccttgggattgctctgggacatcgaaatccagaaaacatgcgcgactagccttgccgtcctgcacgcacaaggggtacggctggacggtctcacagtggaacggcttgtcccggtggaggacgtgcgaatgttgccttataggcgactggtgggcagagtaggcgcgctgaccgatggccacgcccgattgagcgagcggttccagaacgtcgaagaattgctgcccctggacgagctttacctggaggccagtccggagaacctgaggcaccttctgcagcatttcatgcgcaacacaagcgggcgagtgcaagggaagatagacgagatcgtcttcgagaactcacggggacgcgctcggatggagcacattgcccggatctccgactggcttagaggcctgggcgagattgaactgcaggagggtttgtctgtaggcatcggaaacctgctctctgaaaaggacgcccagaactttcccaggttcactgagggaacgaccccaacctacgtgtttgacgctgggacgttgaagagcgagtcaagggccgcagtgggcctcagtaaattcgggccctacagccggcatgtatttacaccgactcgacccaacgtttgcgtcatctgcgaccgcgcaagaagaggacagtttgagctgttcctgcggaaattccgggatggcctgactgttgatgggaagtccctgccgtttggtcgcgggtttctgggaatatatggccttcaggatatcaacctgaccttcgtcgaggcggatgcattcaccgcggacgcgtaccatgctgccgcaagcaaggcagtacggatgggagccgagggcgcaccgtggcacctggcactcgtgcaaacagaacgcgacagtcggcaactggctccccccaagaatccgtatttggtagcgaaggcggcgtttctgtctaatcaaattcctacccagtttgtggcgttcgagacattttctatggcgcctctgaacctcgcgtacacactgagcaacctggcgttggcggtttatgccaagttgggcggcatcccatggctgatcaagagtgataaaggtatagcccacgaggtcgtcatcgggttgggtagtgccgcgatcggggagtcccgattcagccggaaggagaggattgtcggcatcacaagtgtttttcggggtgacggcgggtacctcttgtctaacctgtccaatgccgtgcccatgagcaagtacggcgaagcattgaccgaatctctccaggcgaccctgcagagggttcgcaatgagatgaactggatcaggggggacagcgttcgggtcatagttcacgctttcaagccaatgaggaacacggaggtggagagcgttaaggctgcgctgaaagaattcagcgagttcgacctgcaatttgctttccttcacgttaagcaagaccacccgtacctcctttttgacgacgacagcatcggtacaaaagggcgaggcgagaaaacccccgtgcgaggcttgttcgcggaggtcggacacaacgagacactgctgaccctgaccggaccacagcagctgaagagacccaccgacgggctgccgaaaccgcttctgctcagcctccatagggactctactttcacagatataatctacctcacgaagcaggtgtactggtttagcaatcactcatggcggtctttcctgccagcagcgatgccggtgacgatatactacagcgacctggtggctggtttgctcggaagactggataggctggggtctcgctggtcaccgagtgtaatgctgggcaagatcggaaccacaagatggttcctgtagtaa

SEQ ID NO: 130 - DNA, 2430 bp, Artificial Sequence
  Description of Artificial Sequence: Synthetic polynucleotide
atgcccaaaaagaagagaaaggtggaagatcccaagaaaaagaggaaggtgggtagcgggagcatgagggaaaccaacatctacgagctcagcggcctcgaaaccgtgagtaccagctacagacttttcgagttgcagggcgcgccagagttctctcctgagtattatgctggtgtgagccgcctcgtgaggacgcttagcaggagacaccaggcacccttcaccagtatccaacggggcgagaccatgttgctcgctgcacccgaggccctgagcggtgatctcgcagaacaccataatctggcacgctgggtggcgaccctgaagtcacttggagatagcatagagatagactgcagcgtgagcggagatgagctggaccccataaggctgcgattcctgaacttcatgatccaatctccattgttcaaccacggcgagctctggcagcccagggccggtgatgccttctactaccggaagcctgccgacacgttcgacggaatcgaactgtttgagggtattgccgtgagggccgtgccctacccaggaggcgggttcggcgttatgctcgacgcgaggactaagctgatctcacagcgggctgtgggcgcctacgcggacccgaatttcataaggaggctgaaaaacactagctgcctgtaccgaatgggagacatctggtacgagataaagatcagtggcgcgaatcagaccgtttctcaccccatcctgtttaaggacaaccagcccgtgtcactcaaagcctacctgcacgaacaagcacggcagccaatccccaagtctctgattgatcttaaaggtgacggcgtggtgttgacctatcgcggcagcgatagcgccgaggtcaaagcggcacccgcggaactttgtttccccatagtagacacccatagcaagaggggtgcccggcaccagagaaggagcatccaagccccacacatccgacgcagcaaggcttaccgattcaagcaaaggttcttgcgggacatcaaaataggaaatgccgtgttgagcgtggccgaccaacccgcagccctcaagaccaggcccatcgacttgcccgagctgcaattcggctccaataggattctgtacggcacggacaggggcggagaccgaatcgaccttcgccagtatgccaagaatcggcgaacgctgctggagcgcgcagacgtgggcttctttgagacttctcccctggagccccaatgtttggtacttcctaagagcgtgatgaacgcatggggcaacgagttcgttcgagacctgactgccgaagtgaagcgactccaccccaccggtaactacaagccaaccgtaatcgcgtttgatgatgtcagcgcaaccgtggacgccaggagccaagcagaagccatcttcaagctcgcggaagacggggatctccctccaggcgactgcgccattatgatacaccgaaccaaaggaaaggcaagagcgcaggaggagctgcccgcacttcttataaacaagctgagaaagagctacggagtgaatgccgccatattccacgcgactgtccccggcaacgcctaccgaagggaaagcgccagcgatggcgctcgctatgtgcgcaagcgggatgagaagggcaggtttagtggatacctgaccggagcggcgcttaacaagattcttctgcccaacgccaagtggcccttcgtgctcaaggacgagttggtggcagatatagtggtgggcatagatgtgaaacatcacaccgcagctctcgttttgatcgccgaaggcgggaggattatcaggcacactcttcgcctcagcaccaagaacgagaaactccctgctggtatcgtggaaacgaagctggtggaactgatttcaaatgaagcaccacacctgagcaggctcaccaaaacaatcgccatccatagggacggcaggatttggccctccgagcttaagggattgcgagcagcctgtaggaagcttgccgacgacggccacatcgatcctgcgttcgatctgaacgtcttcgaggtgagcaaaagtgcccctgctaggcttaggctgtttagcgtcgaccgcagtgctggcagaaagccgaggattgaaaacccggaactgggggactggatgatgctgacagaaaccgacggctacgtttgcacgaccggtgctccgctgttgagaggtggtgcggctagacccctgcatgtaaagcaggtcgcaggtgatatgagcttgcaggacgccctttccgacgtgttccgactgagctgtctgacctggactaggcccgagtcatgtagcaggttgcctatcagtttgaagctctgcgatatgctgctgatggacgagggaactgcccacgacgaggacgaaatccttcatgctaacgacgacaccccagccgttagcgcctagtaa

SEQ ID NO: 131 - DNA, 2358 bp, Artificial Sequence
  Description of Artificial Sequence: Synthetic polynucleotide
atgcccaaaaagaagagaaaggtagaggatcccaagaagaaacgaaaagtaggcagcggcagtatggtcgcgctgaggctgaacggcgtacccatcttgtgcgccgctgacgtaaccgtggccgtggcgaagttgccgtacacgaaggagagcctggacgagttgaggaaggagcatgcggggaggtatttgattaggagaggcggagatgacgggcaggaaatcatgtctgttcccttgcttgctgatgctccgcagctgagcgatgccgttgtggaagttaagctgtcagaagcccactggttgctcgcctcactcgcggtggaggccctcaccaggttgttcacagaacttggtagacctatcctgcggtcccggccattgcggctgctctcccaaaagccggccaatctttttccggagaacgtcggactgccagactggctgcaaaggagggttgtgctggatttggagactaggaagatctggcggcaggatggagacccgacattggtgctgctgtgcgatgtgcggactcaaaactttatcgacgtgccaacggataaactgatggccaccggcgtaagcgttatgggtcgctacgttagccgaatggtgagctctgatgatccccggatcacctcacatctgaagctcgccggcagggtcattagcatagagggcgaccgactgctcctcgccgactttggcgagggaccggatagtataagcattgctcatgcctatctggagagacgacgggaaaatgtcgactggtgtgttcaacagctgaaccccgcgaaagcagggcaaatcctgatgagcgtgcaggccgaggctgcgaaattcttgaacggacctggccgattcgagctgatcaagaggacattcgattacctgcgcacgcagagtatagagcttgtgcccgacgtgaagctggagttgggggacttgattggcatgggagccgcacgctggcccttccgccaggaaacaattaagaagcctaccctggtgtttgatccgtctggtgtcaagaccgatacctggaacgagcgagggcttgacaaacacggaccctacgaccagaggaccttcagccccaaggaaatgaggatcgccgttatctgcagggaagcagacgaaggtcgggttgaaggatttctggccaagtttctggacgggatgccacacgttatcgtcggggagaaccgaaaaccctatgaaaagggattcataaggaggttcgccctgagtgccccgaaggtgcacactttcaccgctaagtcttctagtgtgccggactacctgaatgcgtgccgagcggccctgaagtttgcccacgaccaaggctttgaatggagcttggcaatcgcgcaaatcgacaaggactttcgggaactcctcggtcctgacaatccctacttcgcgatcaaggccgcgtttctcaagcagagggtgcccatccaggagttgacgctcgagacaatgagcacccccgacaggcagctggtgtacattttgaataacataagcctcgcaagctacgccaagatcggcggcattccgtggctgcttaagagcggtcctaccgtgggccacgagctggtcattggtattggtagccagaccgttagcagtagtcgattgggcgagaagcaacgggtggtgggcattaccaccgtattcacccacgatggcagataccttttggacgacaggacgcgagccgtgccatacggcgagtacgaagcagctttgtccgagacgctgaccagggccatagagagggtaaggacggaagataactggaggtcaaccgacgcggtgcgacttgtattccacgtgttccagcaaatcaaagactacgaggccgacgcagtggggaaactggtcgagaatctcggcttcagcgatgtcaagtacgcctttgtgcatgtcgttgacagccacccctacaccctgtttgacgaacacatgccaggcgttaagtttggctacgagatgaagggcgcctacgcacctgagagaggcctgtgcatcagtcttggcagggacgaacgcctcctcagctttaccgggtctagggaggttaaacaaacccatcatggcctcccaaggccaacccttcttcgactgcataggaacagtaccttccgggacatgacctacatcgccaggcaggctttcgacttcgcaaaccactcatggaggatgctcaccccagcgcccctccccatcaccatccactacgccgaactcatcgcccggttgttggctggtctgaaagacacacccggctgggacgaggacacaatgctcggcccagtaggtagaacccgatggtttctgtagtaa

SEQ ID NO: 132 - DNA, 3207 bp, Artificial Sequence
  Description of Artificial Sequence: Synthetic polynucleotide
atgcctaagaaaaaacgcaaagtagaagatcctaaaaagaagagaaaggtcggctccgggagcatggattacatacttgaattcgacgagtttattcgaagcatcaagcagaatattgatacaaagtattcattcctgttgggggctggcgcttcagtcgaatcaggtattccgtgtgccagcgaatgcatctgggagtggaagagggatatcttcatcagccaaaatccgaccctggctgagatgcacaacaacatcaagagccagaacattaagcgcagcatccagaactggctcgataaccagggcacctacccaaaggagggcgaggacatcgagtattcctactatattgagaaggctttccggattcccgacgaccggaggaagtatttcgaacgaaacatcaccggcaagactccgtcactgggctaccatatcctgtgtctgctggcggaacgcgagataatcaagtccgtttggacaacaaacttcgacggcttgatcattaaagccgcccataagtaccagttggtgcccatcgaggtcaccctcgagagccaagatagaatctatcggacggatgccaacaaggagttgctttgcatagccttgcatggggactacaagtacggtccgctgaagaatagtaaagaggagctggacagccagtctgacatcttcgtgaatgccctttccttcgaggcgtctaagcgctattttgtggtgatgggatacagtgggcgcgacaaaagcctcatgcaggctattgagcgaagcttttgcagaagcggcgctggccgcctttactggtgtggatacggccggaacatcgcgcctgaggtacgcgtgctgatcgagaagttgaacttgtatggacgcgaagcgttctatattcccacggacgggtttgacaagacgatgttgaacatagcccatatgtgtttcgaggataaggaattgcaggaagaagtggagaaactcaaagcggatctcggtgcggggtatgagtgtcgcaccaccacgttcagcccctacaaggaaggggtgaataagatcgtggacacaaatgtttacccgatcaaattccccgacaagtgctatcagttcgaggtgaagaacagcagcgtaatgaacctctgggattactgcaagcagctgatagactataacattgtggccgtcccctataacggaatgatctacgcctggggaaaccgcaacagcatcagcaacatgtgcggaccaaatgtgaacgggacgatcgaactcgttcctctcactaggaaaatctttttcgacaacggcactctcaagtcaatgctccttaaaactttgctcatcgtgattggaaagcactccaattgcaagtataaccgaaacaaaatctggcgagagtccaagaaaatcaactacactattaacggcaaaaacattgaagcgtaccaaggcattaggtttagcttgttcatggactggaaatacagctacctcaccctgacccccgctttctactacaaagacaggaacaacgttagcaaggaggagaacaaagagttcagcgaccggtttatggagcaaatatgtaagatgcaagccaataagaattacgccgcgtacataaaacactggattaacattatctttcctgatggcaagtccatcatttccatgtacccgtgtaacagcgagagcggattcgagttcaccattgttaataagtcactgctggtcggactgcggagtaggcaagcactgcataatcctgacgatgacatgaagaaacggatttgcatcggtggagctgagttggcggacaccgagctcaagttctacaatccggctcagaatgcaatgcacaccgacttccaccccatgaggggccttatcaacaataagccctacgacttctacatgaataacaggctgtttaaatctaacatctccctgggcgtgatctctcctgtgggttcagagaaaaagctggaggacttcctggaccgactcaacaaaaagcacaaagtgaactacaacgtcgactatgtcatagattatcctgggtttcagtccgtctacggggttggcctttctgtccctctgatcgcagaatgggcgttgttggatgataaaatgctgaataaagccaacctgtatcagagctgccttaacttcggggatcagatcaagaagaagattgagtacctgaagagccgcgacagcgtggacgtgatcatcatatacattccgaaagagtacgagctgttcaccttcttcaacgacggaaatatccattatgacctgcacgactacgtgaaagcattcagcgtgcagaggcacattagcacccagttcatacgggagaaaacaattgactctgagcttgactgccagatcgcgtgggccctcagcctcgctatctacgttaaagcaggccgcactccgtggattctcagtggcttgaggactgataccgccttcgccggcatcggctatagtgtggaccatataaagaccgacaaccagacccttatcggctgtagccatatttacggggcagatggccaaggtctccggtacaagctctccaagattaaggatgtgaccttcgacagcaagaacaatccctacctgtccgaaaacgaggcctaccaactcggcctgaatatcaaggaacttttctttgatagcttcaagacgttgccccaacgagtggtcatacacaaaaggtttccgttccagaagcaggagatcgatggcctgactaagtgtcttgggtccgcgggagtgaaagacatagacctcatcgaaatcaccttggaggatcgatttaggtgctttgaatacgacaggcgactccagattgacggctaccccgtgaggaggggcgtgtgcttcgccatcaacgagaacaccgcctatctgtacacccacggtattgcaccaagcgtcaagaatgccaatctccgctacatacagggcggtaagagcatccctgcccccctgaaaatcgttaagcactacgggaacggcgacctggcccaaattgcgacagagatcttgggcctgtcaaagatgaattggaacagttttggtctgtatagcaagcttccgtgcactatccaatctagcaacgctatcgctcgcgtagggtggctgctctcccagtatgagggcgtagtttacgactataggaatttcatgtagtaa

SEQ ID NO: 133 - DNA, 2529 bp, Artificial Sequence
  Description of Artificial Sequence: Synthetic polynucleotide
atgcccaaaaagaagaggaaggtagaagatccaaagaaaaagcggaaggtcgggagcgggtccatcaccagctacccttacgctaggaacaaggccgacatgattcgcaaggttaattggaatctgatcgtgttcgacgaagcccacaggatgaggaatgtctataagaagtccaataagatcgcccgaaccctgcgcgaggccactgccggctatcccaagatcctgctcactgcaacccccctccaaaactccctcatggagctctacggattgatatcttttattgacccccacatcttcggggatgagacaactttccgcagacagtttagtcgcggcaccaaggaaatgagcgagatggactttatcgacctgaaacaacgaattaaacccgtgtgtcaccgcaccctgaggcgccaagtcacagagtacgttaactacactcagcgcattccgatcacccaggagttcatgcccaccaacgaagaatgggagctgtacgagaaggtcagcgcctatttgcaacgagaacatctcttcgcgctccccgcgtcacaacgagcacttatgaccttggtagtgcgcaaactgctcgccagctcttcatttgctattagcgataccctgctgagcctcatcaagaggttggaacaactgctggaacagctggactccggcaagacggagattaccgtagaacacagcgatgtctacgcggacgtggacgagtttgatgatacagtggaggagtgggaggaggacgaccagccttcttacatagataaactgagcccagacgagatgaaacggttgattcaggaggaaaaggaagaactggagcagtactacagccttgcaaaaagcattaaagagaactcaaaggctgaggccctcctcatagcgcttgaaaaagggtttgaaaagctcaggatgctgggggctaatgagaaggccgtgatcttcacagaatcccgacgcacacagatgtatctgagagaattcctggagagaaacggctacgccgggaagatagtgctgttcaacggtgaaaaccaagacgaacaagcgaagcagatctatgagcagtggttggagaagcaccgacacgacgacaagattacgggctctaagacggcggacatgcgagccgcgctcgtggagtactttaaggagcaggctagtataatgatagcgaccgagagcgccagcgaaggcatcaatctgcaattttgcagcttggttgtgaactatgacttgccatggaatccgcaaaggatagagcaacggatcgggaggtgtcatcgctatggtcaaaagcacgacgtggtggtaataaactttctcaattgtaaaaacgaagcggacaagaaagtagatgagatattgtccgagaagtttcggctgtttgagggcgtatttggcagcagtgatgaagtcctggggtccctcgaaagcggcgtggatttcgagaagagaatccaacaaatctaccagacctgccgaaccgcggaagaaattgagcaagcgttcaagaacctgcaagctgagctcgacgagcaaattcaactgaagatgaaggagacccgaatgcatcttttggaaaacttcgatgacgaggtgagggaaaagttgcgagaccattatcaccaaacctccctgcatctgaataggatggaaaggtatttgtggaacctcagcaagtacgagggggcacgcgaagccatctttgacgacgagacgctgtccttcgtgaaggactacgagacctatcagatgatcagccaggcgaagaaacaaaacagtccaaacgtgcatcactttcgattctcccacccgcttgcgcagaagtggatcgaacaggccaagagcagggaattgttgccaaaggagataacgttcaggtacagcgactacaagggcaaagtctccatcttggaaagactcatcggcaaggagggttggttgagtctggacctgcttcacgtccagagccttgagagcgaacaacacctcatctttagcgccatcgacaccgagggcggtcaactggaccaggagatgtgcgagaaaatgttcgagctgcccgctgtggagggcgaggaagtagagatatccgactccatccgaaacacattgagacgaatctcagagggccagcaagaggcaatactgaatgagattatggaacgggcgtccgcctacctcgactcagaactcgagaaactggaaaaatggtcacaggacctcaagaataagctggagaaagacattgatgaaatgacggtggagatcgagcatcttaaacgggaagctaaattgacacgcaacctggcagaaaaactcgaaaaaaacaaacagatcaaggagcttgagaagaagcgcaacgaaatgcgccggaatctctatgaccaacaggacgaaatcgatgaacaaaaggaccgcctcttcgaggaggtagagaaaaaacttgaacaacggactgcgacggagcacctcttcactatcaaatggcggatcgtgtagtaa

SEQ ID NO: 134 - DNA, 2337 bp, Artificial Sequence
  Description of Artificial Sequence: Synthetic polynucleotide
atgcctaagaagaagaggaaggtcgaagatcccaaaaagaaacgaaaggttggatcagggtctcttcaccttaactacctcccattgcgctttaccgccgatatattcaagggtggtgctttgacatttcccgaaggcagcgagaaaaactggaccagcgacgatccaatcagcaaggagctgagcaagttgcgagagaaacacggagatagtcatgtcttccaccggatgggaaacaaaattgcatgtatccccgttgtggagaacgccattgctataggcaccgagacggatttcaacatcattagtgactttcagctggctaatgctcttgctcgcagcgccctccacaggtacttcaaagctgcgggaagggagactgtaattgggttccgacccgtaacccttctcttggaaaaacacaacttggccagcaacaggaaggacgtgttcggcattttccccgagtacactctggacgtcaggcctcttgcaccacatgagggcgacatagcgagcggagtgcttatcggctttggaataaagtatgttttccttcagaacgtagccgagctgcaggcacaaggggtgagtgccgcagggatgtacgccgtgaggctggtagacgagagcgaacatcaatttgaccgggcctacctgggaaggattgatcggttcacaaaagataacgtgacgctcgttgacagcgattacgcggaatatcccgccgaccagtgttacttcgagggaagcaggaccaacatcgaagccgtgggccgaagtctcctggggaaagactatgatgccttcagctcaagccttttgcaggagagctacaaagtgaccggagcccccaaccaaacccaacgactgcaccagttgggcgcgtggctcgaggccaagagtccgatcccctgcgccgttggtctgggagtacggattgcaaaaaagccgcatgagtgctcacgaggcaacgacgccgggtacagccgctttttcgacagccccaagtgcgtgctgcggcctggcggctctctgaccgtgccctggccggtcgacaagcagatagatctcaatggcccttacgacgctgagagctttcccaacaagagggtacgaattgccgtcatctgccctcaggaattcaccggggatgcggaagagttcctccggaagttgaaggagggccttcctaacgcaccggacggcagtccgtttcgcaagggctttgttcgaaagtaccatttgtctagctgtgacttcacgttccatgaggttaagcggagctcaaacagtgacgacatctacaaggatgcgtcccttgaggcactgaagcagaagccagatatggcaatcgccataatccggtcccaatatcgcgggctgcccgatgcttctaatccctattacacgacaaaagctaggctgatggcccagggcgtaccagttcaactgctgaacatagagaccatcaggaggaagtctttggactacattctgaataacatcggtcttgcgatgtatgccaaacttggaggaatcccttggaccctcacccagaatagcgacatggcgcacgagatcatcgtcgggatagggtcagcccggctcaatgagagcaggaggggtgctggcgagagggtcatcgggatcacgaccgtgttcagtggtgacggacagtacctcctcgccaacaacacccaggaagttcccagcgaagagtacgtagacgcattgactcagtctcttagcgagacagtatcagagcttaggagccggttcggttggcgccctaaagatcgagtgaggttcatattccaccagaagtttaagaagtacaaagacgcagaggcggaggcggttgataggtttgcacgctcactgaaagattttgacgtgcaatacgccttcgtgcatgtgtctgattctcataactggatgctgctggacccagctagtcggggggtgaaattcggcgatacgatgaagggcgtcgccgtccctcagcggggacaatgtgtgcccctggggccaaacgctgcgctgcttactttgagcggtccgttccaggtaaagaccccactgcaaggctgtccgcaccccgtgctggtgtcaattcatgagaagagcacttttaagtctgttgattacatagcccgccaaatcttcaatctcagcttcatcagttggaggggctttaaccctagcaccctcccagtgtccatttcctactccgacatgatcgtagacctcttgggacatcttagacgcgttaagaattggaatccggaaaccctgtctaccgctcttaaggaacgaaggtggtttctgtagtaa

SEQ ID NO: 135 - DNA, 1779 bp, Artificial Sequence
  Description of Artificial Sequence: Synthetic polynucleotide
atgcccaagaagaagagaaaagtggaagatcccaaaaagaagcgaaaggtgggtagtgggagcatgaatttccagctgtgcgaccaacgcaaagccattatcgccgaaccaggccatctgttggtcctcggtgggccaggaagcgggaaaactaccgtcgccctcttcaaggccaagcagagatttagcactctgaaacctagccaagaaatcctgttcctgtcattcagtagagctgccatcaggcaggtcctgctgcggtgcaaggagattctgaagcccgcagagagacgcgctgtcgccgttcaaacctatcatagcttctgcatggacatgctgagggcgcacggtagactgctcctgggccaccccgtgcgattcatgtatcccggcgacgagaggcttcaaaaggccgcattcgagggggactgggaggcggaaagacaaaggcaagccaaagagatgggcatcttttgcttcgaccttttcgcgcaaggcgcagctgagttgctcgagaggtgtgccgcacttaggaagcttataggggacagcttccccatgataatagtggacgagttccaagacaccgacgacaaccaatggcggatcgtggcgcaacttgccaaggtagcggacatcttctgccttgccgaccccgaccagaggatctttgactaccgagacgacatcgacccccttcggatcgagggtttgcggaccactcttgcccccagggagttcgatcttggcggtgagaatcaccgctccccgaacgcagggatattgaacttcgccaacgctgtgctgcataaccagagccccctgcccgataccagcgacatcatgcaactgcggtactggcctagagcgttcgcgagcaccgtgcatgcctgcgtagtgtttaccttcagcgaactcaggaaactgggcgtggagaaccccagcgtggcagtgctgagccgatccaacgggcttatcagcgatgtgagcgccatactggctgagaagcacgcgtacaacgggagggaactgccaatcgtggaacacgacgtggtttgggacgcggagctgtctgcggcagcagccgtcgtcgttgcgtccaccctggagtggccaacagccgctgcagaggttgctgttgccaggacacttgcgctcatagcagcctattacaagctgaagaacgccgaggaacccaccaagagcgcggctgaggctgcccaaaagtacgaggcggctgcaagcaaggtggccagtgaggagaccccaaggatcaaagccgcgaaagaattgctggccgctcaccaaagtggcatccagatggtgggcgacccggtggccgattggaagtctgcgaggagggtattgcaagagataagcgccctgggtgagttgtacagggaggtccggctcgtgaggttgttccgggcaaccgacgccttggcttccggcctgagcaataggtggttggctactggaagctacgagggcgtgtccgacctggtgaagggcatccttgagcaggagaaactgattgccgtggaaagggacccaagaggctgtatactgatgaacatccataaaagcaaaggtaaggaattcgacggcgtggtactcattgagggggcatttaagtcccatttcttcgatgagcggaaggaagtcagcccctatgagaggtccagacggctcctgagagtcggtctgacccgcgctaggcatagggtgacaatccttagacctcagggagcgaggccccttgtggatcccatctagtaa

SEQ ID NO: 136 - DNA, 2286 bp, Artificial Sequence
  Description of Artificial Sequence: Synthetic polynucleotide
atgcccaaaaagaaacgaaaggtagaagatcccaagaaaaaaaggaaagtgggaagcggaagcatggagaacctggctcttagtgcgctgcaactggactctaagctcgaccgctacatcgtgtgcaggtacagaatcgtgtaccagaagcgagacgagaccattcccggcgaacagttggcccggaaggcggcctacgagatccagaaagcgaatgacttcgcccttttgaccaacctcggcaatcaacacatcgtttccctcaagcccatctcacagaggggcattgaaagcacccaccttcaggcgaatctcatcgaagacggggacctggagctcgattgctccatcgaacaacatcagcaggcactccagcggctcgtgaaccaggacatcaataaagctgcgtggaagcttaagaagagctcacagggcaaactcgattacaaaaaggcagctagcgggaacaccgagatctttgagccaattcatagcactcgaatcaacgcccgagccacgtatcttgacgctttttgctcactgcagcttagccccgaggtgcttgctaatggaaccgtactgatagggctgcatctcaagcacaatctggtagcaaagtctgacatctctttgcagtggatcattgataaaaggcccgattggctgcagagcatcaagaaggtgcggcacaggtacttcgatcccggcaaagcgcccctggtcgccgaattcctgagggtggaggactccctgaatggcaacagcgtcttgccccacatgggccagagtcttgtttcataccaccaagcgaagggactcttgtcagaaagacagctcgcagaggccacgaagagcgtgctgataaaggtaaaatacggcaaaaacgaggcggaccacatcgcatctctggttgaaccaatgtttgatttcgacacgctcagcaagatcgatagtatcttccttaacaagttggcaaaggacctgaagtggagcctgaacgacaggatacgcacttccgcgaaaatggtgaaaggcttgtatctcccaaacttcaactgcaagctggaacaggttgactatcagatccttcacaggcagcgacttaatcaccaacagatgcttcaattcgccaacggggcgaaatcttcaagagagcaggacgtgctgcgacataaggcgttcggcaacatgacgcgcacacaagttatcccgcttattgcgggcgagaagaacaatacagaacaaaataagcagctcctgtgcaacgcataccaagcattgcaacaactgaccaccacggaattgcctccgttcaccaagttccccaaccccgtagagaacgcagccgagctggacgcaagactgaatgaacggtgtcccccaaatgcgatactgctcatcggccttatcgacaaaagcgacaaagtggcgatccgcgacaccgcgtttagctacggtcttgcaacccagttcatgcgcctggatcacagaccgaacgtctacagcccctcatatttcaacaacgtggcggctggtttgttttccaaaggtggcgggcagctctgcgccattgatgacatgccgggtgaaaccgacttgtttatcggtctcgacatgggagggatctctgtaagggcaccaggcttcgcgtttctgtttctgcgatctggtgcgcagttggggtggcaactcgcggacaaacaacagggagaaaggatgcaggatgaggccctgatgtcactgttggacaagtctctcaccacctacctgagaagctgctctggtgagcttcctaagcgcataaccctccatagggatggcaagttctacgaaagcatagaagtgatcgagcagtttgagcagaagcacggcgtgaaagtagatgtgctggaggttctgaaaagcggtgctccggttttgtatagacgaagccgcatggccgacggaaccaaggagtttagcaaccccaatgtgggcgacgcgatctatctcagtgatcatgagatgatcctgagcacgtatagcggcgaagaactcggaaagatatggggtgacaaggtcagcgtcaggcctcttaggctgcgcaagagatacggtgatgtgagcctggagaccctggcacatcaagtgctcgtgctgtctaggatacacggcgctagcctgtatcgccatcctcgactgcccgtgaccacgcaccacgccgaccgattcgcaacactgaggcaggaaacatgcatagacgccctctctaagatggaccggctctgtccggtctacctgtagtaa

SEQ ID NO: 137 - DNA, 2322 bp, Artificial Sequence
  Description of Artificial Sequence: Synthetic polynucleotide
atgcccaagaagaagagaaaggtcgaggacccgaaaaagaagcgaaaggtaggtagtggttccatggtcggcggctataaagtcagcaatttgacagtggaagcgttcgaaggtatcgggagtgtcaacccgatgctgttttaccaatacaaagtcaccggaaagggaaagtacgataatgtgtataagattatcaaaagcgcacggtacaagatgcattctaagaaccgattcaagcccgtgttcatcaaggacgacaaactgtacaccctcgagaagctcccggatatagaagacctggatttcgcaaacattaacttcgtgaaaagcgaggttctcagcatagaggataatatgtcaatttatggcgaggtggtggaatactatatcaatctcaagctgaaaaaagtgaaggtgttgggaaaataccccaagtacaggatcaattacagcaaagagattctcagtaatacgctgctgacacgagagctcaaagacgagtttaagaaatcaaataagggttttaacctgaaacggaagtttagaatttcccccgtggtgaataagatgggcaaagtgatactctatttgtcctgcagtgctgatttcagcaccaacaagaacatttacgaaatgttgaaagagggcttggaggttgaggggctggccgttaagagcgagtggagcaatatcagtggcaacctggtgatcgagagcgtactggaaaccaagatatccgagcccactagcctgggccaatccctgatagactactataagaataacaaccagggctatagggtgaaggatttcaccgatgaggatctgaatgccaacattgtcaacgtgagaggaaataagaagatctatatgtatattccgcacgcgttgaagccgataatcacccgggagtacctggccaagaacgatccagagttttctaaggagatcgagcagcttatcaagatgaatatgaactaccgatatgaaaccctcaagtcatttgtgaatgacatcggggtcattgaagagctgaacaacctgagcttcaaaaacaaatactacgaagatgtgaaactgctgggttactccagcggcaaaatagacgaacccgtcctgatgggggcaaaagggatcataaagaacaaaatgcagattttttccaatggattctacaaactccccgaaggcaaggtacgatttggcgttctgtacccaaaagaatttgatggcgtgtcaaggaaagctatccgcgccatttatgacttcagtaaggagggcaaataccacggcgaaagcaacaagtatatcgcggaacacctgataaacgtggagttcaatccaaaggagtgcatatttgagggatacgaactgggcgatatcaccgaatacaagaaggcggctctgaaacttaataactacaacaatgtcgacttcgtaatcgcaatagtcccgaacatgtccgacgaagagatagagaacagctacaatccgttcaagaaaatatgggccgaactgaatctgcccagccagatgattagcgtcaagacggccgaaatctttgccaatagcagggataacacggcgctttactacctgcataacatcgtcctcggtatcctgggtaagataggagggattccctgggtggttaaagacatgaagggcgacgtggattgcttcgttggactcgatgtcggcaccagggagaagggcatacattaccccgcctgcagcgttgtgtttgacaagtacggcaagcttattaactattacaagcctaacatcccgcagaacggagagaagattaacacagaaatacttcaggaaattttcgacaaggtgctcataagctatgaggaggagaatggagcctacccgaagaatatcgtgatccacagggacggctttagccgagaggaccttgactggtatgagaactacttcggtaagaaaaacataaagtttaacatcatcgaagtcaaaaagtcaactccgttgaaaatcgccagtataaacgagggaaatatcacgaatcctgaaaagggttcctacatcctgcgcggcaacaaagcctacatggtgaccacagatattaaggaaaacctgggaagcccaaagcccctgaagatagaaaagagctacggcgacatagacatgctcacagctctcagccaaatatacgcactcacgcaaatccatgtgggggcgaccaaaagcctgcgcctcccaatcaccaccggctacgccgacaagatttgcaaggcgatcgagttcatcccccaagggcgcgtggacaaccgccttttctttctgtagtaa

SEQ ID NO: 138 - DNA, 2304 bp, Artificial Sequence
  Description of Artificial Sequence: Synthetic polynucleotide
atgccaaagaagaaacgaaaagtggaagaccccaaaaaaaagcggaaggtgggcagcggcagcatgaacaatctgatgctggaggcgtttaagggcattggcaccatcaagcccctggtgttctataggtacaagctcatcggcaaggggaagattgagaatacctacaagacgatcagcaacgccaagaataagatgagtttcaataacaagttcaaagcgacgttcagtaagggagagaccatctacacccttgagaaattcgaggtcatgcccaatcttaacgatgtgaccattgagttcgacggagaagaggttctcccgataaaagacaataatgaaatttactccgaagtcgtgcaattttacatcaacaataaccttcgaaagatcaaactggataacaaatatcagaagtatcgagcaacgaataccagagagataactggcaacgtcatactcgacaaagacttcaaggagaagtacaagaagtctaagtcagggttccagctcaagcgcaaattcataatttcccccaaggtgaacgacgagggtaaggtaaccctgttccttgacctgaacagcagcttcgactatgacaaaaacatttaccagatgatcaaggccgggatggacgtggtggggcaggaagtgattaatacgtggaataataagaagcagaagggcaagattaagaagatttctgagctgacgatctcagagccttgtaacttcggccagtcccttatcgattactacgtttccctcaaccaagctgtgagggtgaagaactttacggaagaggaaaagaacacaaacgttatcgtcgtccaggtgggaaagggcgaggttgagtatattccgcacgcgctcaaacccatcattactagggagtacataaagaaatacgatgaggccttcagcaaagaggtagaaaacctgatcaaaatcaacatgtcatacaggtacgaaatactgaaaaagttcatcgacgacatcggctctataaccgaactgaacaaccttaagtttgagaacacgtacatagataacatcgagtcactgggctaccaacagggaaagctgaacgatcccgtgctgataggcggcaaaggcatcctgaaggataagatacatgtgttcaaatccggcttttacaaaagccccattgacgaagtcaagttcggcgtgatttacccgaaaggccacaccaatgatagcaagtccaccatccgggcgatttatgatttttgtaccgacgggaaataccaaggcaaggacaacatcttcattaacaacaaactgatgaatatcaaatttagcaaccaggactgcgtgtttgaggagtacgagctcaatgacataacggagtataagcgagccgcgaataagttgaaaaacaacgagaacatcaagtttgtaatcgccatcatccccgcgattgatgagagtgatatagaaaatccctacaacccttttaagcgggtctgcgccgagttgaatctgcccagccagatggtaagcctgaagaccgcgaaaagattcggcaccagcaagggtaataacgagttgtattttctgcataacattagcctgggtatcttgggtaagatagggggggtcccttgggtcattaaggacatgcctggggaagttgactgcttcgtgggcctggatgtgggcaccaaagagaaagggatccactaccccgcatgcagcgtccttttcgacaagtacggcaagctgattaactattacaagcccacaatcccgcagagcggcgagatcatcaagacagacgtgctgcaggagatcttcgataaagtgctgctgagctacgaggaggagaacgggcagtatcctcgaaacatcgtgattcacagggacgggttcagcagggaggacctggagtggtataagaactacttcatcaaaaagaatataaacttcacgattgtagaaatcaagaaaaacttcgccacccgcgtcgcgaacaacataaacaatgaagtgtccaacccatttaaagggagcttcatactgcgcgagaacgaggccatcgttgtaaccaccgacatcaaagataatatcggcgctccgaaaccaatcaaagtcgagaagacatacggcgatattgacatgatgaccataatcaaccagatctacgccctcacgcaaatccacgtcggaagcgcgaaatctatgaggctgccgatcacgaccggctatgccgacaaaatatgtaaatccatcgaatacatcccgagcggtagggtggacaaccggctcttcttcctgtagtaa

SEQ ID NO: 139 - DNA, 1737 bp, Artificial Sequence
  Description of Artificial Sequence: Synthetic polynucleotide
atgccgaaaaagaaacggaaggtggaggatccaaagaaaaaacgcaaagttggcagcggcagcatgatagccgtggaagagtggcaacctgcggacggactgacccttgagcctaatgcaaagagggctgcgaaggctagaaagaggtgcctggccctgacagcgggtcccggtgccggaaagacagagatgctcgcacaacgcgccgacttcttgttgaggaccggaacctgtcggtaccccaagaggatactggccatctcattcaaagtggatgcaagtagaaacctgaaggacagagtggagaggaggtgcggctatgatttggcgtcaaggtttgacagttatactttccacgcgttcgccaaaaggatcatcgaccgctttaggccggtgctgacaggcaaggacgccctcgacgcaggctacaccatcgtggataagaagaatggcccctctaggacccagatcgagttcggcgaccttgtcccccttgccatacaaatcctgcaatcaagcaaaattgcacgaaacgcgatccgccaaacttacagcgacatcttcctggatgagtttcaggactgtacaaacctgcagtacgacttggtaaaacttgcgttccagggtacgtcaatacggctgacggctgttggcgataccaagcagaagataatggcctgggctggagccctggacggcattttccagacgtttgccaacgatttcaacgccgtgtccctgaacatgtataggaatttcagaagcaagccacaactgctcagggttcaaaatgaaattatcaggaagttggaccccgattccgtgatgcctgacgaacaacttgacggtgatgaaggcgaggtctatgcgtggaggttcgaggatagctgcaaggaagccgtgtatcttgcggaccttatcaatggctggatcaacaccgaacagctgcccccagcggagatcgccgtactggtcagcaaacagctcgacctctatgtcgaccacttgatgactgagctcgaggctcggggaatcccctacaggaacgagcagcagcttcaagacatcaccatagagccggcagctagactcattgtggactacttgagttgcctctacggcaagagagagccgaaagcatggatccggctcatgaaccagctgatcccattcgcggacgaggagatccaatctagtgctcgaaaggacctcgaccagttgataaagaagcagagaaaaagggtgagcgacgcgaagcacaccgattcacctttcagcgattgggcacaactcgcaattgaattcctgaagtacataggcagtaagatgctggtggcactgagtccagattacgagacgcgcgagaggctgaatgacgtgatcagggaaactttcgcgaggatcaaggaactgttgaagagcgagcccgacctgcccaaggcgctgggccggtttgccgatgaccaggcggtgcgaatactgaccatccacaagagcaagggcctggaattcgacagtgtgatcatcatggccgtcgagaacgagatattcttcgggaaccaggacgagaataggtgcgctttcttcgtaggtgtgagccgagcaaaaaggaggttgatacttacccacgccgaccagagggaaaggccagcgtctgccaagcgatggaatgttagtagaaccgctcagactgagtacattagttacgtcacccctttcgtgaggccacagtagtaa

SEQ ID NO: 140 - DNA, 2298 bp, Artificial Sequence
  Description of Artificial Sequence: Synthetic polynucleotide
atgccgaagaaaaaacggaaggtggaggaccccaaaaagaaacgcaaagtgggtagcggctcaatgctcgactttagccttacccagaaaggttgggtgctgcccatcgtactgaacgcctttccgctcaaggtaccggacatggagctcaaattcgtgcagatcccctacgacaagacgaccctggactcactgaggtcaagccacaagatgacccacgtcttcaggaggcaaggcgacagtatccagatcttttctagcgacggcacctttccaaagagcggcaccccccagaccctccaactgaaggataatctgggaatctttttctctcttgtaaaggacggcctcctcaagcacttcgccggtttgggccgaaccccgtgcggattcaaccccattgaggtcgtgtcagctcaggccaaagacaatcttctggctagcatcctcggagaagcctacccgctgaaaatttgcgccaagtactccatcgacaccaggacagtgcaaggtcaaccgtgtctcatcatcgactgcagcactaggagagtggttaaagagaactgcctcttcttccttaagaccggctttaacgtgattggccgctatgtagtgaccgagcaggacgacgggtttcggaagctgctgggttttgtggaaaactgccacgaaggcaggacactgagcgttataaggccagatggccaagccgtgcatgccgaggccaaggacgtgtatctcgaggcatctagggccaacttcgacgactacatcctttatacgcacggaactaaaaaggatagcatcgtggagcgaatcagacaaagcgtgagtatcttcaacggcggtaagaacaagaaagatagaatcgacgcgctcaaaaagtacatccaggccaccaatataagccttttggatgggaccaggatcgaaatcgaggagcccagcgacattcagaaggactgcgcccagatgcagaagcccgtgtttgtgttcaatgacaatggcgaggccgactggaccgagaaggggctgactcagaacggcccctacaccaagcgcaccttcgaccgaaacgaccccagcatctgcgtgatctgcgcacaacacgacagggggcgagtggagcagttcgttaggaaactgctgaaaggcatggctaacagcaaatacttcagaaacggccttgagggcaagttcgcgctgggaacgtcccgggtagaggtgtttgagaccagcacaaatagcgtggacgcctataagagcgcgatcgaagccgccatccgcaagaaggccgatgacggcggcaggtgggacctggcattggttcaagttaggcagagcttcaagcagctgaaggtgactgacaacccctactacttgggaaaaagcctgttctacatgcaccaggtgccagtgcaggatttcactatcgagctcctgagccagtccgactattcactgggctacagccttaacaacatgagcctcgcttgctacgccaaaatgggaggagtgccctggctgctcaagtcctctcccacccttagccacgagctggtgatcggcatcggcagcgccaacattgtccaggagaggggggcacacaaccagaggatcatggggataaccaccgtatttagtggcgatggcagctacatcgtcagcagcacgtccaaagctgtggttcccgaagcatactgcgaggcgctgactagcgtgctgggcgagaatatcgaaaaaatccaaaggagaatgaattggcaaaagggtgactcaatccgactgatcttccacgcccaagtgaagaagttcaacaaggaggagattcaggcagtgcgagccgtgatagacaagtatagggactaccagatcgagtacgcttttgtgaaaatcagcgagaaccacggcctgcacatgtttgacagctcaaccgccaccatgcccaagggcaggttggccacacacaggggtaagacctttaagctgtccaaaaacgagatgttggtctacctgatcggacagagggagctgagacaggaaaccgacggccaccccaggggtgtcatcgtgaacgtacacaaggacagcactttcaaagatatcaagtacctgagcgcccaactgtactcttttgcgagtcattcttggaggtcatacttccccaaccctatgcccgtgaccatcacctacagcgaccttatcgcccacaacctcggctggctgaaccagctgcccgggtggtctgacagcgtaatgataggtaaaatcggtcatagccagtggtttctgtagtaa

SEQ ID NO: 141 - DNA, 2091 bp, Artificial Sequence
  Description of Artificial Sequence: Synthetic polynucleotide
atgcctaagaaaaagaggaaagttgaggatccaaaaaagaaacgaaaggtaggcagcggcagcgtaaagcttaatcacttccccctgaatcccgctcttgcagtgttcaagactacctacaggcacagaaaccccaggggcttcctgggattcgttaggtcacaagggttgaccgcggagagagttggcgaggaagtgtgtgtctatcacggtcttccccacccggcttttagaggagccaccgcccaaggacacaccagactggcgcctggtgacaccgattacgacaggggcgtacttagtctgatcggagccgccctgctgaaagcgggttacgtgcttactgagcgcgaaagggccgcagtgcaccccacgcagcagagagtgcccctgcacacccctaggaaactccctgccgaaattgcggtgaatgcccatcttcgatgggaatgggaactggaacggcacagcgggaagtcttggcttgtgcttaggcccggacgcatgtttttgagtgcgctgagctggcacgatttggacctgagggcatgggcacaggagttgccccagagcgtacagcaactgcacgcgctgtgtcttcgctccggacgacgagaacgactgaggcgcatgggtaacacgtgggcgttccaacgagaggatagggagcaagagggcaggtggcacctgagctttagcactaaggcgctttccgacctgaacctgtccggcgatgctcaccatgctgctagcctgagcatgcccgatgtgcagaggctcgtaaatctgccgggtctgtggcagccctttgtgacaagccttgaagtccttgaggtgcctggtaaggtgatcgagggcaaaaggctgaggttcggacgaggaacagggcgcgacgtcacggatgtacacaaaaggggcatccttcaccctccgccgcagccagtgcgccttgcggtcgtgccccccattcaggcggacgaagaggcggatgagcagttgagacgcgagctccttgcccacctcctgccacgggaaaaggtgttggcccaccccgaggcttcccagggcctcaagaagcacttgaatcgaagggaaaccgacgacaccttctacaccctgtggagcgctggagactactgcaaactggggctggaaccctttgatctggtgcgcgacctccataggtacgaccccggcacgggtcgcctgctggctccagagaagttgcatggagcagcagccgccgcgagagaggctggcaggcaattgattggcctcgtgatcctgcccgacaccatagggcgagatgagagggacgcactgtccgacgaactggccaagctgggtgtgaagaaacttcagcacatccgcagggacatgctgaaccggcccaggacgcagtatatggcctgggtgaacgtggccgtgaagctcgcccagagggccggagcagtcagctgggacctggaaaagttgcctggagtgtgcgaacagaccttcttcgttggcgtggatctgggccatgaccatcgggagaagcaaagcgtcccggccttcagcctgcacgagttccgaggcaggccggtcgactgcctcacccttccaaggcgagccggaaatgaaaggttgagcctggcggagctgaatcaaggcctgaggaagctgcttaagggtaagaggccagcccaagtgatagtgcatagggacggcaagtacctggagggggaggttgatgacttcataatcgctttgaacgacctcggcgtgccgcgcgtcagtcttctcgccgtcaaaaagtccaacctctccatggttgccggcgctaaggagggagcgtttttgccactggacgagcggcggtgtctgctggttaccaatacccaagccgcggtagctaggccgacagagctggaggtgatgcactcagatcatctgactttcgccgagctgaccgagcaagtgttctggctgacccgagtattcatgaacaacgcacagcatgcgggtagcgaccctgctaccgtagagtgggcgaacgggatcgctaggaccggaaagagaattgccctgtctgggtggtccgcctagtaa

SEQ ID NO: 142 - DNA, 2199 bp, Artificial Sequence; identical to SEQ ID NO: 112
  Description of Artificial Sequence: Synthetic polynucleotide

SEQ ID NO: 143 - DNA, 2067 bp, Artificial Sequence
  Description of Artificial Sequence: Synthetic polynucleotide
atgcctaagaaaaagcggaaagttgaagaccccaaaaagaaacgaaaagtcggaagcggctcactggggctgaataatgagtccaaagagttctttaagggcattagccgcatttggagaaattacaaggactacacctaccttgacgggattaagctgagccaggcgcagatcgatatcatcgagaaggaggaagaccaattgcttatagagggctacgccggcaccggtaagtccctgacccttatatacaagttcattaacgtgctggttcgggaagatgggaagagggtgctgtatgtgacttttaacgatacgctgatcgaggatacgaaaaaacgccttagttattgcaacgagtacaacgagaataaagagaggcaccacgtagagatttgcacattccatgagatcgccagtaatatcctgaaaaaaaagaagatcatagacaggggtattgagaaactgacggctaaaaagatagaagattacaaaggtgccgctctccgcagaattgcgggaatcctggctaggtacatcgaggggggaaagtattatagcgagttgcctaaagaggaacgcctctacaagacacatgacgagaactttatcagggaggaggtggcctggatcaaggccatgggctttatagaaaaggagaagtatttcgagaaagatcgcattgggaggtccaagagtatcaggctgacgcgctcacaacgcaaaactatattcaagatatttgaaaagtactgcgaagagcaagaaaacaaattcttcaaaagcctcgacttggaggattacgccctgaagctcatccagaacatagataatttcgatgaccttaagttcgactacatttttgtggacgaggtacaggatctcgatcccatgcaaattaaggcgctgtgtctgctgaccaatacgagcatcgtgctgtcaggcgacgcgaatcagcggatttacaagaaatctcccgtgaagtacgaggagctcggcctcagaatcaaagagaaggggaaacggaaaattctgaacaagaactatcggtccacgggtgagattgtcaagctcgcgaactcaatcaagttcttcgacgagtccatcaataagtataatgaaaagcagttcgtaaaatccggtgatcgcccgatcatccggaaggtgaacgacaaaaagggtgcggtgaagttcctgatcggcgagatcaaaaaaatccacgaagaggacccctacaaaacaatcgccatcatccaccgagagaaaaacgagcttatcggcttccaaaagtccgagttccgaaagtacctggaaggccagctgtacatggaaaaattcagtgacatcaagtcctttgagtcaaagtttgatttgagggaaaagaaccaggtgttctacaccaacggctacgatgtaaaggggctggaatttgatgtggtgttcatcataaacttcaacacggccaactacccactgagtaaagagctgaagaaaatcaaggacgaaaacgacggcaaggaaatgacgctcattaaagacgatgtgctcgagtttatcaatcgcgagaagaggctgctgtacgtagctatgaccagggccaaagaaaagctgtatctcgtggccgactgcaaaaacagcaacatcagcagcttcatctacgactttaacaccaagtactatgaggcacaaaatttcaagaagaaagagatagaggagaactacaaccggtacaagattaacatggagcgcgaatacggcatcatcattgaggacgacgactccaacaacgttaagaacaatgacacgaaacaagagaacaagtttaataccgaatctaaggaaaagggcaaagatgacatcgacaagataaaggtgtttttcatcaacaagggaatcgaggtggtggacaaccgagataagagcgggtgcttgtggatcgtcgccgggaaggaagcgatccctcttatgaagaagttcggtgtcctgggctataacttcatattcatcgcaaacggcggtcgggcatctaagaaccggccagcctggtacctcaagaatagctagtaa

SEQ ID NO: 144 - DNA, 1941 bp, Artificial Sequence
  Description of Artificial Sequence: Synthetic polynucleotide
atgccaaaaaagaagagaaaggtagaggatcccaagaagaaacgcaaggtggggtccggcagtatggaccgcgagatcattgaaaacttcaaccccagcgaccccaggaccgagggcgagaagtatctgatggataacttttcaacctcccccaggtttaatggctggacaatatttgagcagccccacatcaactcaatgaagcccgacttcatcttgctgcacccccacaagggcatcataatcatagaagtgaaggactggaacctcagcagcgagacatatgagaacggcggttacatctggggggaaaacggcgagaggattaagaaaaaccccatcaatcaagtagaaaactacaaaaactctatactcaagatggaacttacaaacagcatcgaatttagtgaagtgttcggcgacaaatacttcgcgtgcatagaaacggtggtatactttcacaaagccaacaaaattcaagccgagaacttctgcaggaggaacaataactacaccaagatctggaccaaggacgagttcgactacatatgcaatatcaataacaaactgaagggcagttgtcacacctatgccctgagctacgaaaaaagcacccttgaagacaacagaggtatgctgagtaaactggtggaggagctcaagtgcaatctccagtacagtgactacaactatgaacgacgccaaccgattaagttgacctatgagcaagagaagttggcgaggctgcaaaagaattcaatcaggaggtggagcggcgtggcaggcgctggcaagtccctgagtctggcgcaaaaagccgtgaacgccctgaaggaggaccatagcgttctgatcctgacctacaacataaccctgaggcactacctgcgcgatctgtgctctcaacagttcggacccggctcctacaaaggcgagcgcaagaagctgaggagcgacctgaccatctgtcactttcatgactttttgagaatcatcatggccgagtacgagatcgaggtcgaacatgacgaagacgacaacttcacccagcactggataaacaagatcgacagttgcataaaggtgaacggcatcaagagccacctcaagtacgactatatcctgatcgacgagggccaagactttgaaggcgaatggattaggttcctgaagcagttcttcaccgaggtgggtgagatctttatcgtgtacgacaaggcccaggatctctacgagcatggcgtgtggatcgaagacagcaaccaaatcaaaaacatcggctttaagggcaagcccgggaacctgaaaatcagtatgaggatgcctgagaagatggtgtacctggtgcaggacatcagaaatgagttcaagatagatgaggaggagatcaccccaaacgtgaacagccagcagagcttcatcgagataaccaagtggattaactgtatgcccctgacgctcactgaaaagctcgaccagattgaaatacaggtggactttctgcgccgaaacaacaacagcctggaggatatcacgatcattacgaccaacgaggagaccggagtggagatagtgaataggttcaaaagcaggggtatcaagaccagccacgtctacgatatggagaagcgggggaaccaggccaggcgaaggatggaaaaatggaaattccagggcggcaccggcagactgaagatttgtagctatcacagctataagggctgggagactccgaacatcatccttgtgctggacgagccgagcacaaagtatgaagacggcataattagtaagggggagtataacgagaagaacattttcgacgctatcttcattagcatgtccagggtgaaaaggaaagcccaaaccggtgagtttagctttacgtgcctgaattatcttagcgaatacaataagattgagggcctcttccactagtaa

SEQ ID NO: 145 - DNA, 1392 bp, Artificial Sequence
  Description of Artificial Sequence: Synthetic polynucleotide
atgcccaagaaaaagaggaaggttgaggaccccaaaaagaagcgcaaagtaggtagcggctccatgctgaccaataatcagattgtgctggagcaggaacttctgggaagcatattcaaaaacaataacctgatgctgaaagcccgagagaagataaaaccggagatgttcctgtatagcaaacacatgaacatttacctgggcatcctcgacatggtggccaacaagctggaggtggacctgatcacctttctcgagcaccataagaaaagggtgggggatatggatggcgtaacttacgtgaccgagatctacacctgcagcgcgtccgacattggcttcaatacaaaacttgacatgctggtgaacaactacaaacggcatctgtatgtggagatgaaggacaaaatcaacagtgatatgagtcttgaggagatcgagagcgaggttgaaggggtgaaggtaaaggtgcacaaatgcaacatcaagaaagaactggatatagacaagcaatatgacgattacatcaactggctttacgacgaaaacagagacaaggggatgaaaagcggcctgacctatctggacaagtatctcggcaacttccagaagggcaggctcgtcaccgtgttcgccaggagcggcgtcggcaagaccacgttcagcttgcagctggccgccaatatggctctgaagggccacaagatattctacgggagcgcagagatgacccgcaaccaggtctttaacaggatcgtggcctcaggtttgagccttagcgcgaaggcgattgatgaggacaccatcctgaaggaggacaaggagagcatcgccaagtttatgaccaaggttatcaacaacaagttctacgtgtcaaccgagaccgacttcgaaaagttcatcgacgagataaaggtttataagctgcagaacagtctggacgtggtgttcgtggactacattaacaagtacatcgacttcaccgacagggacatgttgaccaacaaactggggaagatcagcggcatgctcaagagcctggccatggaagaggatatctgcgtggtgctgatggcccaggccaatagagtgattgacaagaaggtgggtgacaatgccgtcgaaaaaatcgacagcagcgacatccaggacagcgccagaatcgagcaagacagcgaccaagtgatcggcctgtaccggaacgtgaagctcgatgataaaatgtatagggagaacctgttcaatcagggcaagctcaagtataattccaagaacgccgacgacaatccggaatgcatgaacgctgtgatcattaagaacaggcatggcgaccgaggcacgtgtgcactgaggtggcacggcaggtacagcagggtcagcgacttctagtaa

SEQ ID NO: 146 - DNA, 2619 bp, Artificial Sequence
  Description of Artificial Sequence: Synthetic polynucleotide
atgcccaagaaaaagcggaaagtcgaggatccaaagaagaagcgcaaggtgggttccgggagcaaagggcggcaccaggcgaaacactacgcggacggcctggaaaaaatgcacgggcaaaggcctgtgattttctacaccaacggccacgatatatggatatgggatgaccatccggctcagcactacccgcccagacggttgtacggattctacgcgaagtccagcctgcagtatttgataaggcagcgcagtgaacgcaaggcgctgaatacggtgagctctaaaaccgatatactcggagaaagactctaccagcacgaggcactgaagcggatctgcgaacgcttcgagaccaagcagaggaaggcactcgcagtccaagcgaccggcacggggaaaacccgcttgtccatcgcacttactgactcttgcatgaaggccgggtgggtgaaaagggtgcttttcctgtgcgaccgaagggaacttagaaaacaagctaagaacgcctttagcgaattcctcagcgcgcctattagcgtactgacaacgaaaagtgcgcaggatacccacaatagaatcttcgtggcaacctaccccgcgatgatgaaggtgtacgagcaactggatacgggattcttcgacctgatcatagccgacgagagtcaccgaagtatttacaacatctacggcgacctctttcgctattttgacgcccttcaagtgggcctgaccgcaacccccgtggagatggtatctcggagcacctgccagctcttcgggtgtgactttaagcaaccaacttctaattacacactcgaaacggctgtggaggagggttatttggtgccctaccaagtcgtgaaacataccacaaagtttctgcgcgatgggatcaagggccacgcgcttagcgcggaggaactggcggagctggaggacaagggcatcgatcctaacactcttgatttcgacgccgagcagatcgaccgagcgatctacaataaagacaccaatcggaaaatcctgcagaacctcatggagaacggtatccggcaggccgatggccagaccctcggtaagacgctggtatttgctaggaaccacaagcacgccaaactcctcgaacagttgttcgacgagctgtacccccagtacggcggtaagttctgtcaggttatagacaactacgaccccagggcggaagagttgatagacgattttaagggcgagggcagcaacgaacagctcactatagcaatctcagtcgacatgctcgacaccgggattgacgtcccggagatcgtaaacctcgtattcgcacggccggttaaaagccccgtgaaattttggcaaatggttggtcggggaacgcgactctgtaagaatttgtttggacccggcaagcacaagacgcacttccttattttcgaccactggggagtcgtggagtatcacggcatgaaacaacgcgaggtaactgtgtcccagagcaagtccctgatgcagcaattgtttgaaaatagattggagctcgccaagaccgcgttgcaccacgccgaagccgacttttttgagacgatggcggggtggctgcacaaaacgataaatagcctggacgatcgaacgattgccgtttgtgataagtggaaaactaagcagcaaatgtccgacctggagacgcttagacagttcggtgcaaacaccgtcacgctgcttgagtcagaaatcgccccgttgatgcaatggctggatgtcagagggcatagtgacgcatatcagtgggacctcctggtctcacagatccaacaacaaaaattgaagcaggcggcagccttcgatgatctcgctgggagggcaatcaatcaactgtggcagttgcagatgaatttgaatcaagttaaggcaaagtccgagtggattaagcagtgccgagagacggagtggtggcagaaggcgtccctggatgaactggaacaaatgcgacaagaactgcggggcattatgcagtacaggaacaagggtgacattccgaagacagaggcgcccatcatagacataacggactcagaggaggtgcgcgagaaacaatcctcctacctgaactcagttgacatggtcgcgtatcgggtcaaggttgaacaggcgctccaggagctctttgagagaaaccccatccttcagaagatccggaacggggaggccgtgtctgagcgcgagcttgagaacttgaacgctctcgtgcatacacaacacccggatatcgatctcaacacacttaaaaagttctatgggaccgcggctccgatggatcaaatccttcggacaatagtaggcatggacgggaacacggttaatcagcgctttgcggcgttcatacaacagtacccctcactgagtgcgcgccaagttcaattcctgtccctgctgaaacgacaaattgctcagagtggggccatagagattgacaacttgtacgaaatgccattcgcagctatcggcgaacccgacagcgtatttagtaacgcggaacagattgatgaccttctggcgattgtggagagcttcgggaagcagccccagcagcagtctacgagacaggccaatgagacatagtaa

SEQ ID NO: 147 - DNA, 1902 bp, Artificial Sequence
  Description of Artificial Sequence: Synthetic polynucleotide
atgccgaaaaagaaacggaaggtagaggaccccaagaaaaagcggaaagttgggagtggaagcatgccgttcaatagcaacctgatcttcgtgaagctcgacgacctcaagagagcctttctcgagggcgtccacagtggtcacgccgtggtgtatgaggtgagcgagggactgagcaccgaggatctgaagaaaaggcttatcaaggccagcgtgatgtaccactataggtatggaaggaacgtgtttgtcttcggcgtcaaggagggcactaaggttgacgatcttgtaccaggccgacgactcggcgagcacgaggtgaaggaggttctcaagggcatcccgtctaacaacctggtgtccatgatgagcgccatgctcaattaccagctctctgtgcttctcaccagcaagggcttccagtatagctacgaagagatgcggaggggcaagtatctgtgtgtcagcaactattacggcaagctgatacggaaccccgtgaaggtttgcctcaaggtaaatgtcataaggagcctcattgacgagcaggatcagtacctgcccatcgcgcttaactacagggtgaagaagagcaggcggcttagccccgaagtaatgaatgagatccacgcggagttcatggaggccttccccagctacctcaacgacctgaaaatcataactcgcgtcttgaacgacgatatggtgaggaacagggaactgaaattcctggagatcgagtacaaaccccctgctatcattacgttccggtttcgaggcaacagcaccggcgaaaacgtgaccgacattctgaagctgggcccctacttcctgcctggggaggaggagaagatcgatgtggtctttgtgtacgaaaatgctctcgctagccaggcgaagaaactcaccaaggttttggaggataccatcaaggacgggctgggcataaagctgaacatagacgacgaacataagttcagccacgacaagccgctgggcgacgttattaagctggtgcgcgaccgattcatcaacagcgggagttgtctgctggtccttagcaaggagaaccgcctcggtcctatcttcatgagcattaaaccgctcacgctcaagaagaacttctacttcaagtctcaatttatcaccaacgaaacgattagcaaactggactcttatgcggtcaaagccaatatcgtgaatagcatcctgttcagggttgaaggtaccccgtacatgcccgttctgcggggcaatatagacgtactggcaaacaatttgttcgtgggcatcgccctgagtaagcctctgaggaagggctacaccaaaggaggcatagccctcatagacccctacagcgcccgaattatcacaagggccatcgtgttgaagcgcaagatgaggagcggcaaattcgaagcctcagacatgcacgagatcgtgtccaacatcaaaggcgtgctgaaggactacaaggagctgtacaacgtcaacgaacttgttatacatatctccaagtttctgagcgatgacgaatacggccttttttacgagtacttgcaggaccttaatgtcaacgtgcgactcctgagcatcaggaagagggacgacattacactggttagggacgggaggatggacagcctgaccatgatcaagcgcggcaagagtcatgtcgaggtcatgtattggcctcacgaaagggcctaccacccccttactatcaggatctacggcgacaatgtggacagggacgtgatgatgcgacacctgaggtttatcgagctgctccggcacatgtactacccggccagcagccgcttcatagttgagcccgcgaccattagctacagcaggagggtcgccagatttgccccctggctttcagacaatacctagtaa

SEQ ID NO: 148 - DNA, 2367 bp, Artificial Sequence
  Description of Artificial Sequence: Synthetic polynucleotide
atgcccaagaaaaaacgcaaggtggaggacccaaagaagaagaggaaggtcggaagcggcagcatggagaaacagaccttctaccagggcaacatgtacaggctgaaggatgaattgatacaagatatcctctctgacattatcgtggcgagagtaactaacatgccaagcaatcccgaagaagcctacagtgaaatacagaagattggcggcattatactcaattacgatgagatgaccaacagcgcctgggtggtgggcaaggagtctctgctgcaaaatcactatcccgacgacatgaaggaggtgcgagccttctccttttctgagctgtccaaggaaaacaagacgaaactggtccttaatatccttaacgccgagggctacctgcgcgacattagggggcaccgagaagtggtgaagtcaatcaactcagagcgatcaatcattagaaaattcttggtgacggtcgagtacgatggtcaacacttctatctcgtaaccctcccaaagtataagatcatagagaatcacacaataatggaactcctcattgagggcaagatcaccgtcaaagagctcgtccacaacctcctcaaggaccctaagtggaaaatccagaccagtcgcaaagatgtgcccctgcctcctgggcacagggtcgtggagatcattctgaagactaaagatcccgatcgataccagcaggaactcgaacgcatcaacgagtattttactaagaagacggaactggggcccattgacgatagcaagtatccagatgattataacatcattttcagaagccagacgcgaggcaaatacttgagctatcacagtgcgcggaccaagctcatcagaccgattaacaaagaaatcctccgagaaatctacaggagtaacgaatttatcaaagcactgaacatcgccaaaaagctggtggccgacatcatatacgacagcaccaaatacccgggcagggccatattccccgcctttaagatagacgaacggacgatctcatacaaggccgtgttcctgaagaataagacgataactgagaaaaccatccaaccctactacaatatcaagggtacctttaattggcttttcaccaacacgccgttcgacgatattagcgagctgataataccaatccagtcccccgagttcttgagggataagaccattggagtgtacatcctgtaccctgcgaagtacagagagaactccgaaagcctgaaagtgatccagaatcttatcaagagcgtagatagcacgatcaaacggctgagcgagtactttacattccttcgaaaagtcaacgaaggcctgtctctcccctctgctatagatatcatctctcggatcccggttaactatgaaaacttgatagagagtgcgtttacccggatccacagcaagaagggcgttgaatatgactaccacctcgcgataacactgatacctgacatgcggcaggagcagttcgataaaatcaaagggttctttttcaataacgggattctgcacaaggcaataaacatcaataatctgagggaccccagcaaagaccaaaagaagctgattgagagcatgatcctccaggcactgtacgcctttggcatctacttctacagccttgacaacctgaactacgactttatcataggtctcgacgtgaccagggaaatggacaagtctggtaggtactacggtatatccggagccgcggtggtccaaaataagaacggccaggtattgaagattataccgatcaccagcccccagagcagcagcgaaaccgcaaacattaactacctcatcggcaatatccaacaggaagccgctgcaatcctgaatcggaagggatacgcggacatattgttcctcagggacggcaaagtgcccggtggcgaactggaacagtttaaagagatcagccgcaagtacaactacaggtttactataatagagatcctcaaacgaccccttgtccgctttttctgggagaattacaaggagcacaccgtgaagagccctaggcataactactacttcaagataggcgacacgtattacttgaccgcgcattacttcacgaattacctgaaggtcccactcaaattgggtaatacctatttcgtggcccgaggaaagataagtaaaaacgtgattagccgcgaggacataatgacaatcacaaagctcactaagctcaactatagccagcccgagaacccggacaaaatgaagctgcctgcccccgtgcacctgagccaccgactgatcaattatgagaggagagagcttaagttcaacaggtatgagtttcttaaggaaggagcgctttatttcctgtagtaa

SEQ ID NO: 149 - DNA, 2253 bp, Artificial Sequence
  Description of Artificial Sequence: Synthetic polynucleotide
atgcctaagaagaaacggaaggtggaagatccaaaaaagaagcgaaaggttggtagcggctcaatggcctatagccttaacgctttcgaactggaaattcccgacattgacgccgacctctacaaagttgaccctcaaccctctgatgacccatatcgaatcctggggggtttggaacggtccttcgagcaacaactggacggcaaggcccagaaatggaaacaggcggaggacggagattggtatatcgccgtgataggcgcgtcagaaaggaaaactatcgagtccccctccagcggtacgagggcaggctacaccaccacgcatacgctggatccgagtagcttttgggacaggatggtgttgcaaagggcaattagcgactctgtacgatggtacatgaccaactatcaggacttttggtatcatgaggatgcggatgcactcttttatccttctcctagaggcaaagtggacgagtacgacgtctacaccggatttagtcatagggtcgagttttatgacagcccacaacttgtcgtgcgcagcgtcactaagttcatctccagtgaaagcctggcggaccggatcaaccatcagggcacagaagaagcaacggaaaaatacggtggtgagaactttaggctggacaggccggaaccaaccaaatgtactttgcacggcatctcaaccgagcgaacggtaagtgacaagacgatagattttggtgacgagatgctgtccgtgttggagtttgcacaaagaaaatatggcagcgagtgggcggacaaaatcgatcccgacgaaccattggtgcagatacgcttcgggaacagcgacccctacgacaccgctccgagcctgctgaatgcgagccctgaggagctgaatcgcaggctgaccagcgaggcagccctcagcgcacaagaaaggcagaaggccatacagaacttcatcggcaggatacactacatccaggttgaagacgagaaggtgagcgtcagcgatgacggcgtacggcccaccgagcagggcgacttcgactaccccgatcttgcgtttggcaatgacgaggtgctcagcaccggcgtcccgaacgcggtagatcctagccaggaggtgcacccgggcaactggcgatggataatcagggactacctggaggaatacggcttctgggagtcacaacgaaagctgtctgagatcgtgctggtgtacccgagaggcgaagaaagacgggcagagaacctgtaccaggacgttagggagaagctttcagagataggaggcgttcagatcaggagcgatccacatcgcgtgtgttacaccgatcaggtggagttcgacgaatgggtggctgaattcggtgactcaatcgacggtgttcttggattgattgagggagatggagacgaatactacgaaatcatagatgcatttggcggagcaccgacccagtacgtcaacactagcacctactcagagcacagaggggcgagcgacgacgtgatctttaacactgcttgcggactggccgtgaagttgggcgcatatccttttggcctggccaacgacctgaacagtgacgtgtacctcggccttagcgtggcaggggatagaagcacaacggccaccgccgttgccatagacggaagagatgggaggattctctatcaaacagaggaacccctgggccagggtagcagcacagtaagcgagggctatcccgctaagcgaatcatccagaggagcctgaagaccgcctcaagcgcctttgatcgaccaatcgagagcttcgacattcacaggaacggagactttggcgacgctgagctggaaacccttagcagtgaattgcctgcactccaggaccaggaatatgtgcataccgatgtttcatggagcgccgtcgaggtaattgaaaaccacccttacaggctctttagtgaacggggcagcagagctcccgataccggagcctatgctaagctggacgacgagcatgtactggttactacctttggagagccccagatccaccaaggtacgccaaaaccggtcctgtgcaagaggagagcaacgagccaagatcaagacatcaccgccatcggagaggacgtgttcaaactcagcttccttaactggggtagcccaatgatgaagatgaagccacctgttaccactaagattccgaaggaactcaacgagattttcgagaagtgctctagggtgagatacccccccttctagtaa

SEQ ID NO: 150 - DNA, 2304 bp, Artificial Sequence
  Description of Artificial Sequence: Synthetic polynucleotide
atgcctaagaaaaaaagaaaggtagaggacccgaagaagaagcgcaaggtcggctccggaagcatgagtcaagactctaggagcaccgaggtggagaggcaggccgaaatacaacctggtacctacctgttgaacggccggggggaaattcagttggatgaggttgacgcattccagtacgacctcaaggtgagtggaggcgtggagcagtattgggatcgggaacaattcaccagctctgcagcctactacctggaccaggaacacgggagccctgtcgctgagataggcaaaatgaacgtgctcagcaagacggatttgtctagatcagttagagtgtggcagagaaacgtgactcccatcaataggcagagcgttacactgaccgcagcccaacccgaggaccgagaaaagatcaaatcattcgtgcaaagctgcttcaagagggcagtgccgaccgaaaaatacagctttcgctttctcaacaagattgtcagggatgagcccgagttcaccaccggcagcgaaggcttttctgcacatccgaagcacgacgttaagatacaggtcaccgctgatggcaatgtgcttgtgcacgtggatagcgggttcagcatcaggagcaacagcaccctggacgaaatctactctgaacaggataacccttacggtaagcgcgttgcccacgaccccgagaggtatggtacccagggccaaggcacccttcgcggttggagcgactatcggtacacagaccatattagcgatgcgggtagctctgtgaacgaaatgcacaaaggggtggcggacgaagaatggcggcaacgactcgcagaggagaatccccgacttctgaaagtggagtatggcaacaaaactaggaggcaagccccccatttcctgaggctctcaccgcggatcgagcaggtgcaggatcaggatcgcgagttctatagcaggtttaacagccggagcgcgatgatgcccgacgaaagatttgaactgtctaaagagttcctgcagaacgtgagccgcttgccggtattggacatggaactcgagccgggtccggtgaacagcagttacgagttgctggaaatgcgagaggaaaacaggctggtttttggagggaagcagagggctagagacccgggcagcgggcttagagagaatggggtgtatcaaagtcccagtcagtaccggctgggggtgttgacccccgaacgatggggagagaaggcgagcgagctgatccccctgattgtgtccggcctgaacgatctgagcgcatcagcaggagttcgagcatatggatacgaattgggggacgtcagcaattacacacccgtggttcaggacctccacgaggagacggacgctgtgctcgccgtggtccccaataagggtgtggccgaggattttgggatagacgatccatacaaggagctgaaaagaaccctcctgcggaaagggatacccacccaaatgatgcaaaagtccacggtcgatgaaatcgtgggtcaaaaggcgggaatcggcaatgacaagtttctgaacgcacttagtgcagtcgtggccaaagtgggcggtaccccatggcagatcgatagcctccccgggaaaaccgacgccttcatgggcttggacgtaacttacgacgagagtagcgagcagcacgcaggcgccagtgcaagcgtagtactcgcggatgggacgactttcgcagccgagagcaccacccagcaaggtggcgagaagttcagtgcacggcatgtagaacagttcgtgagggacctcgtcttcgactttgcgggggaacagggccgagacatcgacagactgtgcataatgagagatgggaagatcagcgaggatattgacgccgtaagagagggactcagtggtattgaggcggagatcgacatagttggcatacgaaaatccgggcaacctcgcatagctgagtttgacggtactcggtttcggatcgccgaaaagggcgtgggctttgtggacgccgacagaagccagtctatcatccatgcattcggcaaacccgaaatccacgacgacaatcctgtgggcaccccacgaacctttcgactgaccaaggactctggtcccacagatgtggagaccctgacccgacaggcatactggttgtccgagatccattttggaagccccgttaggtcccctaggctccccgtgccaatagagtacgcagacatggctgctgagtatgttcgggaggagtacgtctcaccagggactgtaatagaagggccagcatacatctagtaa

SEQ ID NO: 151 - DNA, 2586 bp, Artificial Sequence
  Description of Artificial Sequence: Synthetic polynucleotide
atgcctaagaaaaaaaggaaggttgaagacccgaagaagaaacgcaaggtcggcagcggaagtatgaagacgcaggatgatatcgcgcacaagcaacccattaccatcgaggtccagatcctgaaggagctcgacaagccaagcccaaaaatggccacccggttcctcgtggccgatagggacggcaacaggtttagcctggctatctggaagaacaacgcactcagcgactatgactggacgattggccagtggtacaggctggaaaacgccagaggaaatgtctttaacggcaaacagtccctcaacggtagcagcaaaatgcgcgccactccacttgaggccagcgaggaggacgaaaccagcacggatgatgtgggacgggtcgacacaatcctgggtaatatgagcccggaccaggcttacctgagcctgtttcccatcagtaggtcttttgataccctgtctgtgtacgagtacagcattgaggcagccgaggcattcgaggatgcgccggacaccgtgacctacaggtgcgctggcaggcttcggagaatcacgggtgcgggggtcgcttatgctggctcaatgaggatcgtgtcaacccgcaaactcccggacaagctcgcggacccctttagcttgagtgaacccacggagagggaactgaacgctacggacgccagggacaggcataggatagagcggcttctgaagagcctcgtgaaggccgccatcgacgatagcacctacgacccataccagatcaaccgaatcagggccaggaccccgagcattaccgctggcgacgggctgttcgaggcgtgctatgaatttgcagcaagggtcgatgtgatgccctccggcgacgccttcgtgggaattgaggtaaggtaccacacgcggagccaggtcactgcagacgtttacgaagacaaaaccgcggaactggtgggcaccatcgtggagcatgacccagagaggtacaacattagcggtacgggccgagtagtgggtttcactgaccaccacttcaccgacgccctcgacgaattgggcggtcttagtttggcggactggtacgcgcagaaggatcgcgtcccagagggggtattggaggcgctgcgagagaaaaatcctaggttggttgatattcagtaccaggaagacgaaccagccagaatccacgtcccggatttgctcagggtagcaccccgcaaggaagttgtcaaggagttggatcccgccttccacagaaggtgggatcgagaggccaagatgttgcccgacaaaaggttcaggcacgccatagagtttgtggatcatctcgggtccctgccggatatagacgccacggtggcacccgagcctttggggccgtcactgtcttacatgagcacagcagtcgacagggagaagaacctgcgcttcaaagatggaaggaccgccaccaccccgtcaagcggcatccggagcggcgtataccaacaaccgacgagcttcgacatcgcctatgtgtaccccaccgagtctgaacaggagagcaagcaattcatttctaacttcgagaacaaactgtcccagtgccagtgcgaaccaactgccgctaggcacgttccttatgaactcggcggcgagctgagttacttggctgtcatcaatgaacttgagagcgtggatgcggtgctcgctgtggtgcctccccgagacgatgaccggataacggccggagacataactgacccctatcccgaattcaagaagggcctcgggaagcagaaaatacccagtcaaatgatcgtgaccgagaacttgggcacaagatgggtgatgaacaatacagccatgggcctgatcgcaggggcaggaggcgttccgtggagggtggatgagatgccgggtgaggccgattgcttcataggactggatgtgactcgcgacccggaaaccggccaacaccttggcgctagtgccaatgtcgtttatgccgacggaaccgttttcgcctctaaaacgcagaccctgcagagtggggaaacgttcgatgagcagagcataatcgacgtgatcaaggatgtattccaggagttcgttaggcgcgaggggcgatcccctgaacacattgttatccatagggatggccggctgtttgaggacgccgacgaaatccaggccccgttcgcggatagcggagtgagcatagacattctggacatcaggaaatctggcgctccgaggattgcccaatacgaggacaacagcttcaagattgacgagaaaggccgacttttcatcagtcaagatgacacgcatggattcatcgccacaacgggaaagccggaatttgatgatagcgacaacctgggcactcccaagactttgagggtagtgaggcgggctggtgacacaccgatgctgactctgctgaagcaggtgtactggcttagcgaggcacatgttggcagtgtgagccgaagcgttcgcctgcctatcacaacttactatgcagatcgctgcgccgaacatgcgcgggaggggtacctgctccatggcgagttgatcgagggtgtgccatatctgtagtaa

SEQ ID NO: 152 - DNA, 2577 bp, Artificial Sequence
  Description of Artificial Sequence: Synthetic polynucleotide
atgcccaaaaagaagcgcaaggtagaagacccaaagaagaaacggaaagtgggaagcggctcaatggaagtgtcccccttcttcaacgaactgttcaagtactacatatttctgttttttggtttcaaggtgaacatcgtgaaatcacattaccagagcattaagaagcacaagataatattctattccggtgggatcatggacgagtattacactaacgccttccccatcaacaaatactttatcaaccgcatcatctctgaaaactgcatccgctgcctgtgcaaaataaccaagctcgagaaaaaagagaagatcgaggagttgctttactctatcagcgccaccctggggggcatttacatcgacgattacaacccaatgaagaataagttcagcttctacatttggaagggaatcctgaataagaagattaaatcctacgggtctgaatggctcattaacaagatgaaaaacatgggctttaaggatccggaaaacaagacgctgttgaactatgtgaaaaaaaagtacgagaaagacataaagttcgacatcataaagaaagagaagatagaatggagtaacctcgactgggagataaaggaaaagatagtgctgggcgccataaaaactcaccctaccattcgcaaactgattgaatacaagaatgagaaattcattgacaaaattggaaagaaaattctgacttactttagcatcacaatcaccagcgacgagaacgagaattactttctgatcgtcaagcccaagcataagatcatcagctcagagacaatttacaacatgctgaagaacaacaaaatcgactttaaaactcttgagaggaagctgctgaacggcagcgccctgataaccaccagtagggcagtcggcagacggaaatacgtcaaaatcaaaaaaatcatatcccccaaggagaaggagtattggcaacatacccaggacatcaatgagcactacgaaaaggagggcgtcccgatcagcgtcggcggtgacgacatccactgctatatcttcatcggggaagacgattacgcctaccacacgaagaactccttgctctacgagggtgtgacggaggacgtgcagaaaatactcttggatatgggtaagttcctggaggagctggagacggcaaaatctatcctcaagcagggcaacctcatagacttcagtcgcgaattcctcaacattagcacgaaggacgactacacccttactctcctgagcacactgtccgatatcaaagtgaagcttaagaccgagtctggtatcatcacaggcgactaccagaaacttagggagatctttgactggatcttcgacaagagctttaaccccttgaagcctaagaattgctaccttccgctgagtattccccccatactgaatgacaagaaaaagatcggcgtgtacatcttctatagcaatattagcgaccccgagcttaggtttatcgaagggatctttaagaaactgggcctgatatgcgccatcaataagagtgtgccaaaaattgaggttaaactcaagaaggaagtggactttgaggactacgccaacagcaggatcataatcacccagaccgtactgagcaatctcgaggatggcgagcagccgttcctcatatgtataagtcccttgctgccgaataacgagttcgatgaactcaaaatgcatctgttctctcacccgcagctgatatttcaccaattcatgtatccgttcaaccttcgaaagtgccttgagaaagaatcattcaagaaacccttcatcaactcaatcctgtctcagttctttcacaaaatgggcatgtacctctttagtctgtctgacgagctggggaactacgacttcattattggttacgacataagtagggaaaaggatgacatcgggaagataaaaggtatcggcggctccgcgatcatctacaacaattacggccatgtcaagtcaatcataacgttcgacgacgtagggtctagcgagataggcaggtacgacctcctgttcgcgcaggtgcacagcgaactgataccccacctgaatctgaacaataagcggaaaattaagattctgcttctcaaagacgggcggattttcaaaaaggaactcgaaaagctcagccaaatcagcaagaagtataacttcgagatcacctacattgacgttcgcaagagcacgctgctccggttctggggtgtgcggaggggcaaagtggtgcccgagtataagaatagctacgggaagttcggacgcgcatactatattagtagccattactacaaccgctttttcaagcaaccaatcgcaatcgtggagaagtaccacatagacgagggcaattacaaacgcgtggaaatagaggagaatgatattaagcagctggttctgttgaccaagattaactacagccaactgatgccagataagatgcggctgcccgcacccgttcactacgcacacaagcacgtgaacgccgtgcgacggggctggaagatcaaggacgtctctatactgaggagcgggtgtcttcctacgatctagtaa

SEQ ID NO: 153 - DNA, 2592 bp, Artificial Sequence
  Description of Artificial Sequence: Synthetic polynucleotide
atgcctaagaagaaaagaaaggtggaagatccaaagaaaaaacgcaaggtgggtagcggctccatgactaacaaaaccaaacaaaaaagcaggaagcagaggtccctcatagaatttcttaaggtgaagaagatcaacaaggaagatggtaagaaccataacctgatcaagtatagcaccgaacggatcgatacaggagtgacccagagcctcattgacatcaatatatccagtaacatccttaagctgcggggcagcattgctcaagaggtgttcaaacggaaaattggcgtttactacgggcttgggaagtattacgttgccgaaaacaagctgaagaacaccgatcgaatggatttcttgaagagggtctacgagaccttcccctataactacctcgataaacaggacccgcacagcaagatcagcttttacgagtactacacattccagaagtccatcgacaaagacgtgataaacctgcttgagctgcagaagataaacgagtatagttgggacatactggacccacacatcgccacgcgccttctcacaagctatgtgaagctttacttgggcgactacttgaagccaatcctgtcctctttcgagtacgtccgggctcgaatcaagacaaagcaaaagaccgttccaatcaaaatccccgtgaccaagaagttcgagatccgaactttggggtacgacccgacgcagagcgaaattactctcgccataaaacgacacgccagcatgaacgctgtgctgttgagcagctttccccccgacatcctcgcggttgtgataactaagctcaaacgcctcgtgaacgaggccgtgaagcaagactaccgaaaggtcagaatatactccgagacccagccggggagcggtactgccgcagttgttgaaatcatcagcggcagccaaaacgtgatgaagtttctcgaagagcatccgaagggggccatccacgttgaaaagcgacttaaagagctgggtaaatcactgcaggaggtccggtaccttcttatcggcgtctatgacaacaacgtcagcctggagcgggcaaaaaaagacgaaagataccactactacttcaccgagcataacgcttaccttgtacttacgcccgaggtgcaaaaggcgctctttggcaagttgatcgacgactggaagacaagcattctgaatgagtaccaaaataagctccacgagatcacgagtcttgggatgtttaagcatttggagaccatacggggcatcccggtttccttgaaagagaggcttgtggtccgcaccagcgagggcttgcaaaccgtagatgacattagggacattttgaccaaccccaagattcttagtaatatgttgcctatatccgaggacgcgctcaaggagacgcgaaagcataaactgcgaatcaccctgttctgtccggagaagtttagtgagaggattcaccggactattttctacgacaaattgaaccagtttcgagacggtctgcttagcaacagcttcgcaagcgtggacgaaatcgaattgttccaggtcaaaggcgaaaactctagcgattatgaggagatcatgaaggacgctggccttgataaaatccacgattataccctggcggtcatcatatttcccgaacattatagtaagcgcaaccttgagttgcgcatcttttacaactggctgaaaatgcggttctactcagagaacaagccactggttttccagggcgctcggattgacagcgtcttcggccggtatgcgaagtacgcatcatacaacctcatcttgcagatcccacctaaattgggcatctacccgtactcactggaggagcacgaggactatgactacatcatcggcattgattacacctattggtacgagagagatacgcctagtctgggcggtggcgccgtgttgaccagcccgtcagggctgattgagagcatataccccatcgcactcccgagccgcactgaatccctcaacatgtccaagatactgagcgaatggttcacgcgaacagtcaaaacgaaccggcatatcatagataagggccacgtgaccgtgcttatctccagggacggcatgattcctaagtacgaacgccagacaatccaggagttcctgagtgaatatagcggcgacatgggcatgaccatagaggcagtagaagttaggaaacgcatcgccgtgaggacctgggctacacaagagcccgtggcctactacagcccgataaaggttggcgactgtacctactatctggtcgacgcgcacaccggatacccgctgggggagaaagggaaccgaaccttctacagctcaccctatctcataggaagtttttacaggttcgaaaagggcaaatcctcccccgtgccaggtagcgcaaagaagcacgtgatcgaaagcctgataagacttcaaaaaatcaattacgccaccacccgcatggataacatcaagttgcccctgcccgtcgacatcacccacaaactcattaactttatccgggacaccaagatggaaatcaagggggtcggtatcccaaacagtctctttatgatatagtaa

SEQ ID NO: 154 - DNA, 2187 bp, Artificial Sequence
  Description of Artificial Sequence: Synthetic polynucleotide
atgccaaagaagaagcggaaagtcgaggaccctaaaaagaaacgaaaggttggcagcggtagcatgaagaacctgagatacaaaatcaacgcctacagaatcaaaaaagactatattcccaaggaagtttatagatacaggatccgctccttcatagagaacattaacatatataggttcgtcggtttttacggaggcgtggccctcaatcaatctgagtttatccttccgtacccggtcgaaaatctcgtcctggaatacgacggaaaagatgtaaagcttgagcatatcgacacactgaacctggaggacatcgagaataaggacaaggagaaagccgagaagctggtgaggggatacctgaccagcatatacaagttgaaacccatactctacaagatcctgcgggacgttcgagagagcaagatcattaacgatatcagagtggatcctatacccgactttacagtaaaaaggcacaataacgaatactaccttgtcatcgattttaaccacaccgcgaccgtgttgaaaaatctttgggacttcgtgggaagggacaagctgaaactcgaggattatatcggtaagaaaatcatattcaagcccaacccgaagaagaggtatactataaagagcattgaaaagcagaacaagaaggacattgatgacattgtcgagcacatcatcgagtactacaagtggacggaggaggaaattaagagcaccttcggcgaaatcgactatactcagcccatcatccattgcgagggcatcccctacccgttcgcaccgcaattttgcaatatcgtatttaccatggaagacttggatgagaataccctcaaggacctgcagagctactggaggttgcccaacgagatcaaaggcaacattatcaatcagatcgctaaaaaactgcgatttgtggagaacgagccaatcgaattggaattcattaagttcaataacaccccccttatcgtgaaggacgaaaatggcaaaccaacaaagatatacaccaccaatcgcctcttccgatggaattacgatagtaaatccaaactgtacttgccctacgacatccctgacataatcaagaacaaaacactgacaacgtttgtgctgatcgacgagaatctcaaaaacgtgagtggtaagatcaagagaaaggtctaccaaatgttcaagaattacaataagatcgccagcaagactgagctcccgaaatttgacttcgccaataaatggaaatacttctctaacaacaacatcagggacgtgatccgaaagattaaggatgagttcaacgaggagcttggcttcgcgctcattatcggcaaccgatactatgaaaacgattattacgagaccctgaagatgcaattgttcaacctgaatatcatctcccaaaacattctctgggagaattggtcaaaagacgataataacttcatgacaaacaacctgctcatacaaattatgggcaaactcggaattaagtacttcgcactggacgcaaaagtgaactatgactacatcatggggttggacagcggcctgggcgcattcaaaagcaacagagtgtccgggtgtaccgtgatctatgacagcgaagggaagatccgacggattcaaccaattgacgtgcccagccctggggaaaggatccccattcacctggtagtggagttcctggagaccaagaccgacatcaatatggaaaacaaaaacatcctgttccttcgagacggctttgtgcagaatagtgagagggaggagttgaagaaactgagcaaagagctgaatagtaacatcgaagtgatctcaatccgcaagaataacaagtataaagtctttaccagcgactacggtatcggctccatttttggcaatgatggcatattcctgccacataaaactacattcggaagcaacccggtgaagctcagcacctggctgcgctttaactccgggaatgaggaaaaattgaagataaatgagtctataatgcaacttttgtacgaccttaccaaaatgaactacagcgctctgtacggggagggtaggaaccttcgcatcccggcaccgattcactacgccgacaagtttgtgaaggcccttggaaagaactggaaaatagacgaagagttgctgaagcatggcttcctctacttcatctagtaa

SEQ ID NO: 155 - DNA, 2676 bp, Artificial Sequence
  Description of Artificial Sequence: Synthetic polynucleotide
atgcccaaaaagaaaaggaaagtggaggatccgaagaaaaagaggaaggtaggctccgggagcatgaagccagtgaacttggatgaaaacagcctcaacgacgtcccggtaggcgacacctatgctgtccgcttcactcttgatgcagtcttcgagaacgaagggcagtatccccggaggaatctgaaattcacagacggagggggggatgaccgaaccatcactatttggaaaaactctgcacccgaggaaatttacgaggcggactatgagcgcggtgcgacgtatcttattaccgccgtcgagtatgacatcgacgaaggtaatgacggcgagcgataccagaatctcacagtccaatcagatgctaccttgctggagatgagcggtccccctagtaccgaagaggccttggaagacggcctcgccgaaaccccagatactagcgccgattcaggtgaccacgggttgacaacctttaggactacagacgacctgccggattatgacgtctatgagtacgagctggtgccgaagcaaggattccggccgtccggagaaaatgccctccgagccacatacagggcacgacgcaaggtccgccagcagttggacgtaacacccgtcgtggtcggcgatgcgtttaagcttgtgtctctggtcaagctggcccacgagcgggtcgagcttccgcgattcaagatcaacgaggttgacgagaggcccatcgtctacgccgatgaggatgacagggatgtgttgggggaaatgctcggtgagatcctcaaggacgcgaaacgggaccagtacgacatccatggcatcgacaaaatactggagccagagcccgtcatagagaaagagggcttcaggctccacgaacggtacaacctgaccgtggaagttctccctagcagggccgcttacctgcacgtggactatcgacatcggatattgagcgacaggaccctggatcaactcgatgaagacgaaatccaccctggcctgcgcgtgaccccctcatatagggacatgggtctgtacgttataggcgttgggccggagacggtgaccgataagctgcatatcgagggcaacaagagcctggtccaataccatcgggaagagccgtgggtggacccggcgaaggtgcaagaaatcaaagacgcagatagggaagtgatctggaccgtgaggcaacggggcgatggcaccgagatggcattcccgccggagctgctcgcgcttcaagggcaccccgaaaatttggcccagttcgccagcgactttgctgaacaacaaaggctcaacacgcgcctttccgctgagcaatgcatcaccaaggctaaaaggtttgtggagcgactcgggcccttgcaattcgacggacacactgtggaattcgagaccaacccgctgttgggcgatcggaacatagccatagatggtctgtttcacccggaagcaaacgtgctgcagtttagcggaggccagaccggcacccacccctcagatgtgacacagctgggcgtgtacgaagccccggaccccttcagggtgtgccacatcaggatggagaagcgggacaaaagaatacagaggggttggagtaccttggagacgaagctggagcagattggagcgcctcccgacagtgtcgaggaggtcacgttcgacgccacaatgagccctgaccagttgggtatggagatagcggccgagataccggacgaccatgattacgacgcggccttctgcacattgccacctaaagacaccggctactttgacaccgcagaccccgagcgagtttacgatgaacttaagaaagtgttggccaccaaagaccttaactcccaattcgcgtatgaagcaacgctggacgagcgctttacaataatcaatatagcactgggtcttgtcgccgcagcgggaggtattccgttcacaatcgagagggcgttgccaggcgatagcgaactccacctgggaatcgatgtaacccaccaatacgacgagtccgcgaatggcaaccacattcacctcgctgctgcgacgacggctatccacgctgatggagctgtactgggctacacctccagccgccctcagtctggggaaaagattccccccaaggagctgaaagagatcatcaagcaagcggtgatgggctttcgcacacgctacgatcgctacccaaatcatataaccatccacagggacgggttcgcaaacgaggacctgtccgaggtagaaaagtttctgacggacctcgacgttgaatatgatgttgtcgagatcaggaagcaggccccagcgcgcgtcttgaaatacagtggtgcccacttcgacacgcctcaaaaggcgaccgccgcaatctacgaagacatcccgaaagcgattgtagcgacgtttggtgaacccgagactctcgctagccgggagtcaaccgggcttccccaaccaatcacggtggaaagggtgcacggagagacccccatcgagacacttgctgcgcaaacctacctgctgagccaagcccacataggcgccagtaacgctacagcacgcttgcccataaccaccatgtatgccgacttggctagtgcagcggcagccaggcaacaccttcccccgaccaacaagctgagggataagatcggattcatctagtaa

SEQ ID NO: 156 - DNA, 3225 bp, Artificial Sequence
  Description of Artificial Sequence: Synthetic polynucleotide
atgcccaaaaagaagaggaaggtagaggaccctaaaaaaaaaagaaaggtaggttccggatccatggaagaaaatctgtatcttgaatacgacgctttcttgaggagtgtgaagcgcaacgtggacgtccctcatagtttcttgcttggagccggagcttccatctcctccggaattcagtctgcatacgactgtatatgggagtggaagagagatatctacatcacgaagaatataaacgccgccgagtactataaaaatcataaaaacgaaacggttcgcaaatcaatacagaagtggctggacaaccatggcaactaccccatcctggatgcagcagaagagtacacattttacgccgagaaagctcatccaatcgctgacgataggagaaagtacttctttagtctgattgagaataaagaaccatatatcggttacaaattgctgtgctttctcgcttcacaggggattgtaaagagtgtatggacgaccaattttgacgggctgattgtacgagctgctcaccagaataatttgacgcctatagaaatcaccttggataacgcggagcgcatattccgaaatcagagtactaaggagcttctctgcatagctctgcacggtgactacaaatatagcaccttgaagaatactgataccgaactggataaccaacacgaaatttttcaggagcacctcggaaattatcacgtagataaaaattttatagtagctggttatagtggacgcgacaagtctctgatggatgcactcaaggccgcttattccaagaaaggatctggtaggttgtattggtgtggctatggtgagaagataaattctgaagtgaaagatcttcttaagtatattagagcgagtgggagggaagcatactatatagctacggatgggtttgacaaaatgctcatacacttgtcaaaggcaatatttgaggatagccaagagctgagtgaaaaaatccagaaaatactcgaaagcacgaatcaaaccgagaccttcaacacagaattcaagttggagtttaaaaaaaccgacaaatatatcaaatcaaatctgcaccctattgtttttcctaaggaagtatttcagttgcagatcgagtatggcaatgaaaaaccgtggtccttcctgaaaacactgacaactcaaacgaacattagcgccgtaccgttcaaaggcaatgtctacgcacttggtacgcttagcgagatcaattccatcttcaagccgtatcttaaaagcgaggtcaagagggaagcgatcagccgattcgacatcgaaaacgtcaccgcattcaaaaacctcatgttgacagccatatccaaatatttttgctacacgaaagaagtgaactctaactacaaagataagatttggttgaaaaacatcctgtccaaggtgggggatatcactgttcacaaagcaattttcatatccctgtactttgacaagaattcccattttggttatatggcgttcgctcctaccgtttatttggattccgactgcgaaattgagaagagtcaaaagcaatccatcagtaagaatttgcttgagaagttgtataataacaaatataacgaagagctcgaactgtggaatggtatcttgtttaatcataagaaagtgaaatttgaatatcctcccttgtctggtacggggttcgaatttcagatatcaagcaacactgccttcggggagatagacgtgattgataacaagtaccgctcttacgtcccccagaattatgataataagcagactcagttccggggaatccagtttttggagccgcagctgatatttaagaacatcgcaacgaactctgacttcaaggattatcatcccatgcgaggactgattaacaaccgaccatatgatgtaaatctcaacgggattatccactccaatgaaattaacctctcaatcatctgtagccaaaagtatggagaaaggttgttcgcattcttgacacagctcaatagtaagcacagtacagaaaatatcaacactgactacctgatagattaccccggcttcctgtccgcctttaatctgcccatcaacatcccagccaccaacgatgacgctagctggatggacatcaacttcgtagcagataactctaaagaaacacacgagaacgctatacgactcgcgagggcaattaccaataagatcgagaagatttctgctatacaaagcgccagcactatagtaatctttatacctttcgagtggcagcccttcgaaacatatattaacgaaatagagacgtttgatttgcacgactacattaaagcgtttagcgccagcaaggggatatcaacgcaacttattcgggaggacacccttgacgataagctcaagtgccaaatatactggtggttgtctctttctttttacgtgaagagcctcaggaccccatggatattgaacaaccaggagcggaaaacagcttatgccggaattgggtactccataagcaaggtaaagaacaagtcagagatcgtgatcggatgttcacatatatatgattcaaatggccaaggccttaagtatcgcctctcaaaaattgataactactttctcgataagcaaaataatccgtacctgtcttataaggacgcttttcaatttggggttagtatcagagagctcttctatcagtcactcgattctctgccagaaagggtcgtcatccataaaaggacaaaattcaccgaggatgagatcaatgggataaaggcttcactcaaccaggctggtattaagaagattgatcttatagagatcaactacgatatagatgcaaaattcgttgccatgaacgtgttcgataacaaattgcaggtcgataaattcccgatatccagaggaacatgcattgtgacaaataaacggacggcgttgttgtggacgcatggtatagtaccttcagttaagcagcccaattataagttctacctgggcgggcgctctatccctgcgcccataaagattaccaagcatcacggagaaagcaacattgatgtgatagctagtgagatcctcggactcacaaaaatgaattggaatagcctggatctctacagtaaacttccctctacgatagattcttctaaccagattgctaagataggaaaacttctgtctcgctttgagggccgctcatatgactacaggctgtttatttagtaa

SEQ ID NO: 157 - DNA, 3216 bp, Artificial Sequence
  Description of Artificial Sequence: Synthetic polynucleotide
atgcccaaaaagaaacgaaaggtcgaagaccctaagaaaaagcgcaaggtaggttcaggctctatgtctgtggacgctatgatcaggagtatcggggtcgcacgggaccgcccgcttctcgttttcctcggggcaggtgcctcaatgagcagtggtatgccgtccgccactcaatgtatctgggagtggaaacgagaaatcttcttgacaaacaaccccgacgttgagaagacccagttctccgagctgagccttcccagcgtcagattgcgcatccaagcatggctggatcggcaacgacgctatcccgctcttgatcatcccgacgagtattctacctacataggtgagtgctttgcacgctctgacgaccgcagaatctacttcgagaagtgggtcaaacgctgtagtccgcaccttggataccaactgcttgccgaattggcacggcaggggcttgtggccagcgtttggactactaatttcgatgccttggcggctcgcgcagctacgtccatcaatctcactgcaatcgagattggaattgattcacagcaaagactgtaccgggcgccgggcgaggcggaactggcgtgtgtgagtctgcatggagattatcggtatgatcctttgaaaaacaccgctccagaactcataaaacaagagaaggagctcagagagtcacttgtccaagcgatgagaactcacacagtcctggtttgcggctatagtggtcgggatgagagtgtcatggcagcgttttccgatgcctatgacgcagctcattttaagggtcatcaccccctcttctggacacagtacggcgattatcccgccagtgagcccgtagctggacttcttgcttcaccgctggatcaggaacctgcgaagttccacgtgcctggggcatcattcgatgatcttatgcgcaggatagcactccacgtgagtgacggtgaagcgcgcgagcgggtgcggaagattcttgagaacttcaagacggcaccagttaaccagaagctcccctttgccttgcctagtcttcctgtgacgggtctcgtcaagtcaaacgccattccgttgataccgcctggagagcttatagaatttgatcttgtccggtggccgccgtccggtgaagtttggagcacgctccgggaaataggggatagacacggattcgtagctgccccttttcgcgggaaggtgtatgctctggctacgatagagcaactgacacaagccttcgcggacaatgtaaaggatggcgcgttcaacagggtgccgctgaataatgatgacctccgctacgaggacggaaccgccaatcagctgatgcgacgcgctactgttctggctttggctgggaaagctggatgcgcgaacgatggggatgccattgtgtgggacacgtctcgctcaaaaaccgaaagattggataggcaactttggactgtatacgatgcagtacttctgcagattcggccgctgggaactaagctcgcgctcgtacttaagcctacgctgcgggttacggattcaactggcgaggtagccccgaaagaaattgaacgggcagtcaaggtgcgcgtattgggataccagcataacaaagagttcaaccaggcgaccgacttttggaggaaaaggctcctgccctcaagagatctccttgtcagatttcctgatctggatggtggaatgactttcacgatttcaggtcggccaatattcgcccggctcaccgacgaaaggactgaaactgtcacactgaacgatgcccaagagcgatcagcatctcaagtggggttgcagcttgcagagcctaaactggtgtttgcacgcactgtaggtacgggtcccgcaacggacaccctcccggttagaggattgctgcaaaatagacctttcgatgctaatctgacagacttgggcatcgcgacgaacctgaggatcgcggttattgcgcccgctcgggacgccagaagggtacatgactatcttgggcagctgcatcagcctatagatcctacaaagtgggatgcggactatctgatgaggtttcccggcttcagctccgcttttaaatgccctttggacattccgcagccgggccaggcagcttttgtaacacttgacgagccacacgatgagagtcctcaatcagcgcggacccttgcaggccgaatcacagcggcactgtctgcattgagggcgacggagaatccctctgttacaataatatatattccggcgcgctggcacgcgctgcgagcattcgatctcgaatcagagcaattcaatcttcatgactttgttaaggccgccgcaattccagcgggctgttccacacagtttctggaggagtcaactcttgcaaatggccaacagtgcagagtgcgatggtggcttagcctcgctgtttacgtaaaggcaatgcgcaccccgtgggctttgacgggactcgatagggactctgcctttgtagggctgggcttctctgtaagacgaaagatcgatggcgaaggtcacgtcgcgttgggttgttctcatctttatagcccaaatggtcatggtttgcagttccgcttgagtaagattgataatccgataatgctgcgaaaaaatccttttatgtcctttgacgacgctagaaagttgggcgaaggcatcagggaattgttttttgacgcccacctccggctgccgaatcgcgtagttgttcataaacagaccccgtttcttaaagaggagcgggaagggctccaagcaggtctcgagggagtcgcgtgtgtggaactcttgcaaatttttgtagacgatacgttgcgatatgtggctagtcgaccaatgccgaatggagatttcgaaatccatggctatcctatccgaaggggcaccacagtagtggtcgacgaccagaccgcattgttgtgggtacacggcacatcaaccgcgctcaacccgcggcagagctattttcagggcaaacgccgcataccggccccccttgtgatgaggcggcacgcggggacgtctgatctgatgatgttggcggacgaaatattgggactgtccaaaatgaattttaacagttttgacctgtatggccaactcccggcaaccatcgaaacgagccaaagagtcgcgaggataggcgctctgctggaccgctatacggaacggtcatacgattatcgactctttatgtagtaa

SEQ ID NO: 158 - DNA, 3192 bp, Artificial Sequence
  Description of Artificial Sequence: Synthetic polynucleotide
atgcctaaaaaaaaaaggaaagtcgaagatccgaaaaagaaacgcaaagtagggagtggtagcatgatcaaacacctcaagttcgacgagttccttcgcagcgtgtcaattagtaaggataacacgtactccatgcttatcggtgccgggtgctcaatcactagtgatatccaatctgcctatgactgcatatgggaatggaagaaaataatttacaagtccaataacttgaatactcaggactggatagagaattacaaatcccccaaaacacaagacgtgatacaaaaatggcttgacaaccagggaaacaaccctgagaaagataatatcgaagagtactcattctacgcaaagaaatgctttccgatagatgaaaatagacgccagtacttccaaaaaatctgcgctaataagaagcccagcgtcggatatcgagccattcctctcctggtgaagcaaggcatgctcgactcaatttggacaaccaattttgatgatcttgttaatgtggcgtgtataggtggtggcgttcaggggattgacatatcccttcagacggtaaaccgcataaatcaacgcaatcaaagcaaaaatgaactgcctattataaagctccacggggatttcaagtatggcgaccttaagaacacgagtgaggaacttcagaatcaagacgaaacgcttagatcaaaacttttggactacttgagcgataagaatctcatagtcattggctatagtggtcgggacaactcactcatggagagcttgaaagagacttattcaaaacctggtgcgggaatattgttttggtgtgggtatgggaacagtccatcaaaccaagtgaaggaactccttaaatttatcaaggataaggggcgcagcgcattctatgtttccactgagggattcgataacaccatgctgaacctgaccaagcatgttattgaggacgatgataacctcaaagaggaattcagagaactcaagaagagtatcattaataaaaatacaacgaccccgtttacgttgaacccggaacgaatcaataaggtactgaaaagtaacctctttcctattacattccccaaagagatcttcgtattcaatgcgaccttcgataagaaaccttgggagcttgttaaggaaaaaactctgagtgactatgaaatttcagcgattccatttgaaaaagacatatgggcatttgggactgctaataacgtctacgaaaagtttgcagatatcattaagggcgagatccaacggaagcccctgaccgatatccggctttataatcacaacataaagttcctgctcctgtcaagcctctgcaagctgttctcaaaaacctacaatctgaaaacggactttcggtctaagatttgggatgagagctcatacaaaacggttcacaaccaaaaggtctataacgctataaagatcgatctcgtcaaaatacaagaacagtcatatttgtcactcaatccagactttcaattggcagatgataacgttcccaatgatatcaaccagcaggttggactggaattttttcataagatctataacgacaaatttaacgactatataaacatctggagaaagaagatcctcgaaactacgtcatacgaattgccactgaactccggcaccgggttcgtatttaaaatctctaagaatccaattttcacaaatatagatgaccttaattccaactatacgaacgagcacaatatacccataaacatgattaaacttaagggggttcaattcaaagagacgaacctcctctttagttcacaaaatggagataaagtggttaaggagacccacccaatgagaggcctcgtcaatcatagcccgttcgataagggattgagtagtcttaaaaacactacgatcaacctggggatcgtatgcccccaacaggatagcgaaaatttttatacttttttgaataaacaaaaccaagagattaagaacgttaatattaaggatcaatatgtaatcgattacaaaggatttcacaacacatacggtttgagtctgaacatacctactacgagcagtcctaattgggaaatgactaacgagcctgtctcaagggactcaaagaaaataattcatgaaatcaagaataatatttgcgacaagataaataagctttgtagtataggcggacagaagacaatagtaatatttatccctaaacgctgggacaacttcgtacactataatgatgccgtggaaagctttgatcttcacgattatatcaaagcgttctgtaccgaaaaaaaggttacgtctcagttgatacgggaaaagacgatactcgataataacctcgagtgccagatcaactggtggttgtcactcagttattttgtaaagtccttccgaacaccgtgggtaatcgacaacaccgacaataaaacagcttttgcgggcattggttattcagtagagtccaaaaaagaggataaggggcacattatacttggctgttcccatatttacagtagtaacggggagggtctcaagtataagctttccaaggttaatgataaaatagaatggatcaagaaaaagccgcatctgtcctacgacgatgcttacgaatttggtaaaaatgtgatcaacctgttttacgaaagcatgaatgaggtgccaaaacgagtggtaattcacaaacgcaccttttacactgaagatgagaagcaaggcatacttgactctttgcacgataacaagaaaatagaaaacatagacttgatagaaataaatttcgaagacaacataaggtacgtctcctctaagatatataatcgggaggcaaaaatcgacggttactcagtatcacgcggtacctgtatccttcttaacgaaaaagaggcacttttgtacgcccatggcgtaatcccgagcgtgaagaatccgagttataatttttatccgggaggaaggtacataccgaagccattgaggataataaagcattatggagttggttccctggaacaaatagcaaatgaaatactgggtctcactaagatgaactggaactctctgaacatgtatagccaaatgcctgccacgatcgactcaagtaataagatagccaaaatagggaaactcatagagaatagggataaagtagagtacgattatcggtattttatctagtaa

SEQ ID NO: 159 - DNA, 3078 bp, Artificial Sequence
  Description of Artificial Sequence: Synthetic polynucleotide
atgaaaattatagataaggaaaccttcatcagaagttttaaagttttgagcaatcaatcctttgacctgttcctgggcgctggcgcctccatatctagcggtatcccttccggaggcgacctcgtctggcattttaagcgcgaaatactgaattccaacgggaagataaatattaaaaaatttcaagatcttaagatagaagataataagaaggttatacaaagtttctttgaggagactgaggagaacaacattattaatccttattcctattattttaacaaatgttatccagaccccttgataagaaaagaattcttgacgaatcttgtgagggacaagaagccttccataggatttatgtgcctgtctgctctcgtggagcagcaaaaaatcaacacagtatggacaactaacttcgatgacttgattgagaaggcgattaacggattgaattacaagtcctgtcaaattgtctcacccgagaatgcgggcagcgtgaataactttcgaactgatatccccactgttgttaagcttcacggagattttaggtatgacccactgcagaatactgacgaagagttgcagaaactcgaagagtccttgcataagtatttcgtagaggcaagcacaaagaggggacttctcgtaatgggctattctgggtcagatgagtctgtgctgcaaagccttgagaaggcgctggaagagaacaacgcgttccctaagggactcatttggtgcatccccaaaagtgtcaccccaaaccaacgactggtccgaattatatctaaggctaatgagcagaaccagcggtccggatttatgattatcgacagtttcgattatttcttgcatgaactctacaaaatatgcgaccttacgaatgactatatcgactctattaccaaggagagatttgaaaaaaggcagtcatttaggcttaaccaaactccgtcctctactctgccaatcttgctgaacgcaataaaagcaaagcacttcccgaaaagtacctttctgactaaaacgaatatctcaggcataggtaagtggaaacgcttgcgagacgctataggaaatagctctatagtcggatctttcggtaagaacgattctctcagactttttggaagtgaacaagacattaataatgtacttaagaactacttgattgatgatttgaagatcagtgatatcccagagcacctttttttccattctgattcattctacattggcatgctttatgaactgattgaaaagtgtttgattaaagattatgggctgtcagtatatgcaaaggggagaactatcagaaagttctattcaatcaataacccgctgccggaatctgaaatcgcagatattaagaagagaaacaataattttaacatcgacaaaaatataaatgtatttgaggcgttcgagttctccatagaattcattaataaggagctgttcctgttgctgtgtcccaccatacatattcagactaaactcggaggtgaggtcaatcgcaatatctctcagtacctgtcaaacacaatcatcagcaataggtataataacaaatatgggaaaaagctgaattggtggattaacgagctcaagaagtataacaaggacttggtttttaaattgggggactttgagatacgattgacagattattactccacgagcgctaagcgcgttaaagatgacatctactgttttgacggatttactaagttgagtgagcccagtatatatttccactatcaagacgaagcaaagcagagtatccatcccataagtggactgaagatactcggtccattggaagaatcattcgaggcaaacggtacatcttccacagtcaaccttgccatcattactccggactttggcttctccaaactcaaggcgcacctcgaaagtttgcttaatacaatttcccctatatgggagaaggaatacttgaaggagttccctggtttcgataacgtttttaagaagcacctgataatacccaattctattcaaagcgagtatgtaatcagcatacctaataatgatgtaaaacagttctcagcaattcaattctacgactacctgaagagtaagatcgaccgactcgctctgaagtccaatgacattgattgtcttgtaatatacatacccgaccagtggaagaacttccgagagctgaaaaatgaaaacacatattatgaccttcacgacagtcttaaactctactgcgtaaaaaaggggttgcgaatccagttcatcgaagataaaagcattaattataaagaccaagccaagatccggtggtggctgtctctggggctctacgtgaagtctaacggcactccctggaagatcaaaacagataatacagagactgcctttgtgggcctcggttacgctatacgacaaaatgttaagaataaggttgttctcgggtcttcacagattttcgacggttatgggaatggtctcaagtttcttttgcagcccatagagaagccaattttttacaataaaaaccccttcatgagcaaagaggactcttttcggcttatcagtaatatacgaaacacatatcataagatcgatccagttatcggacttaagaaactcgtgttgcataagacaactcattttacttcagaggagatggaggggatctctaatgctttggaaggcatagacaatattgaactcttgcagattcagcaattctcatcatggagggcaattaagcttatgaaaaatgccacaaagcacgattttaatggttatccgatcgatcgcggaactataattcaactcgacgacttctctttccttctgtggacacacgggcttatagagaaccaagagctgaacggtaagtactaccagggaaaaagaggaataccggctccgcttcttattaagagatttagaggcacggatccaatagagacggtggcaaacgatattcttaagctgaccaagatgaattggaatggtgcagagctctataaaacctttcctgtaacgattgatttcagtaaaaaactttcagtcatggggaagtagtaa

SEQ ID NO: 160 - DNA, 2874 bp, Artificial Sequence
  Description of Artificial Sequence: Synthetic polynucleotide
atgccgaaaaagaaaaggaaggttgaggatcctaaaaaaaaaagaaaggtcggcagcgggtctatgttcgacattggatcaatggtgagagttaggggtcgagactgggtcgtgttgcctggcagttccgcagactttctcctgcttaagccactcggcggatcagatgcagaaacgacaggggtttatgccggtcccggcggcgaagttgtgagatcagcgacttttgcgccacccgatccgcaagcgtttggaacagcctctggcgctcggcttctcctgaatgcagctagattggccgttaggtccggcgctggaccgttccgctcccttggcaggctgggggtagaaccacgcccatatcaacttgtccccctccttatggccctgagacaaagtaccgcccggctccttattgccgacgatgtaggtataggaaagacagttgaagcggcactcatcgccagggagctgcttgaccgcggagagatagagcgattcgctgtgctttgtccgccccatctggctggtcagtgggtaggtgagctgaggagcaagtttgggatagatgccgtcgcggtcctccccggaaccgcgcgaagactggagcgcggctgtaacccaggccaatctgtgttcgccagataccctttcgcagttgtctctctcgacttggtcaaatcagaccgatggcgccaggattttttgcagaacgcccccgagtttgttatcgtcgacgaagcgcacgccagtgctgagggcgaggggttgggcgcgcgaagacatcagagatatcgccttttggaggaccttgcgcgagacccagagcgacacttgatactcgtgacagctacgccacacagcggaaaggaggacgcattcagatcccttttgagattgctcaaccctgaattcgccgctctgccactggatctctccggcgctcaaaacgaaagagctcgggcagctatcgctcgacacttggtgcagcggaggaggggtgacatcactgcataccttcacgaggacaccccatttccagtccgaagggacgccgaggttaagtatactctgcaccccgattatgcggcattgttcgaggacgttctggcctatgcaagggagtccgtgcacgttccaggcgaggcgcatagtcggacgcggatacgctggtgggccgccctgggactgcttcgggctttggcttcttcaccccaagcagccgcagccactctccgggaaagagcaagcaccgaaggcgagactgatgaagcagttattgaaagacttggcagggaactggtgcttgaccccgaagacggtgaacatgggctgctggacgtcacccctggagcgcaggtcgacggtgaagaaagcgggaccacgcgacgccttctcgcactcgcagagagggccgacgctctggctggggccaaagaccggaagctcgcactcctgaccgcacaggtcagggatcttctgcaggaaggtttcgcgccgatagttttttgtaggttcattgcgaccgcggaggcagtagcggagcacttgaggggagttctgaaaggagctgaagtcgtggctgtcacaggaaggctgacgccagatgagcgcgtcgcccgcatcgaagagcttgcaccccacgagcgacgggttcttgtggcaacggactgccttagtgagggcattaatctccaagctgccttcagcgcagtagtacactatgatctcccctggaaccctaccaggctcgatcaaagggagggccgaattgaccgatatggtcaacgatcaccagaggtccgagtgcttacattgtatggggaggataacaggatagatactctgatactggatgttttgatccgaaagcatcggctgatccgggctaccttgggaatgggtgtccccgctcccgacgaggcagaaggattgcttgacgtgctgttggcgcgagtactggaacccgaacgaagaggttctattcagccattgcttctggatgaagtgcaggcttttgatttgaaatggcgcgatgcggctgaaaacgaaaaaaggtcaaggtcacgattcgcccagaactctataaggcccgaagaagtagcaggggaactcgcagcggtacgggaagcgctcggagacgctcgagccgctcaggacttcgttcttgatgcactgcgaggggccggtgttcaggtgacgccgcgccccgacggaagcttcgaagcggaccccacccaagccgatgtagcaccggaggtccgcgactttctgcggggagcaaggcgcttcagatttgacgcacgggtagaacgaggtgtgacgcccttggcgcggaaccacccattggtcgagcaacttgcaagcactgtactgggtcaggctctggagtctccgcaggaggccgcagccaagcgcgtaggcgtcattcggacctctggcgtaagtactcagaccactcttttgctccttcgatggagatttcatctttccggacgaaagggaaaccgatcttggcaaactcttgctgaagaacttgatcttctggcttacgcaggaagggcagaggatccgcagtggttggacgctgaggccaccagagctttgctcgatctgacccctcagggtaacttggatccggtgcagaaagaggaacgccttactcggacgcttgagggacttagcgctttggagggggttttggaccagcgaggaagggatagagccgcagctctgcttgacgctcacgagagagtacggggagcagcgcgagggcaaggggtgacctattctgcggagcctcctggccccccggatctgcttggtgtctatctctttctccccgcaccaagactcggaggcctcgcctagtaa

SEQ ID NO: 161 - DNA, 3027 bp, Artificial Sequence
  Description of Artificial Sequence: Synthetic polynucleotide
atgccatcagccgagaggtgcatctgggagtggaagagggaaatcttcatcactaaaaaccccttgctcagggaaaccgtcggcgagctgtccctccagggcacgaaggaccgaatccaaaaatggctcgatcaacgcggcgaataccccgcactgaactccccagaggaatactcattttatgccgaggagtgctacatcaccgaacaagacaggcggagcttttttcagcagtacgtagaggtcgccaagccgcacataggttatagattgttgcccctgctggcacagaccaagatcataaaaactgtatggacgactaactttgacgggcttgtcgccagggcctgtcattccaacgacgtggtgtgcatcgaagtcggtctcgacaatacccaacgcattacgcgccagcattctgagggggagctgcgggttgtaagtctccacggcgactaccgatacgatgagcttaagaatacagatgagcagctcaggtaccaggaggaggcgcttaaaaacaatatagagcacgagctgcaggactacgacctggtagtgatcggttactccggcagggaccggagcctcatgaacgtactcgaaaacatattcagcaaggccgtgaagagcaggttgttttggtgtggctacggcgaaacgataagccagcccgttatggagttgttggagctggcccgcaagaataatcgagacgcattctatgtcagcaccgaaggcttcgacgacaccgttgaaagaatcagtaggaagctgcttgacggcaacatgctgtccaaagccttggctgagatacaggagaccacttgcatcaccaaccaatctgccaaattcaccgcacctgaaaacgacatcagcagccttattaagtcaaacgcataccccctcctgaagctcccgtctcagttccttaaagtgaccctcaaatacccggaggggtcctttagttacattgattggcttaactccaaggttgacttcaaggaggttgtgttgtctaagatagacaaggagatcatcgcgttcgcggatgttgataagctgaggaagtatctgggcgagttctacctgtctacgcccacggtggtgaactttagcaaaacggacgtgcttaacgatactcgcattcagagtctggtgaggcgcggacttatacagtccatcgtaaaaaacctgaacctgtccagcgaccagaacaagcgaatatggaatccagacgtgagctccatcgaattctacaacggcaagaagtacaaaatcatcgacgcgctcatcctcaatcttagttttatcaaagatgacatctacctcacgttcaaacccgatctgctggtccttaacctcgacgagagcctgccagacaacgatatagttaagactatcaagaacaaaaagttcggctaccagcacaacaaagagtacagtcagatcctggagaagtgggccaaccttataacgaagaaggatttggtcgtgagtggcgggagcgtgttcttccttgggaagaaaccgctgtatgccggacttgtgtcttacgccgcgaggaaactcccaacagattataacaagcacgccacccagaaaggactgatcattcaagacgcgaaactgattttttgcagcaattccatctccaatgagatttctcacatcaaccccctgaaggggctcgtggaaaatcgcccgtgggactacaaaaacaccagctctgggctgtgccccgagatctgcattaacgtgatctcaaccaggcaggacgcgggtgtggtgagcaaccttctccgaggtattcacgagaagtccttcccggaaaaatccgagcaagattacttgcaccccttccatgggttcacaaacgctttcggggtgcccatcacgatccctaagatcggtgagaatacgtggcgctttgtggacgaagcactgagtgcacagaaggccatcgataacgcgaagaacctcgcgaaccgcatttgctatgaacttgacagcctgaagaagcttgaactgcggacgggcaccgtcgtgatcatatacatccccaagagatgggaagcattgacatccatcaagtctgagcatgagtacttcgacctgcatgattacatcaaggcctatgctgcgcaacagggcattagtacgcaattcgtgcgcgagaaaacggttaattcaagccaaagctgccgggtaaaatggtggctcagcctggcgttctacgtgaaggctatgcgcactccgtggcggttggagagtattgataaccaaacggctttcgtggggatagggtacagcatcaatcgcaatatgcatcccgagaattccaagcggataattcttggatgctcccacatatactccgcccgaggcgaaggcatgcagtttcaacttgggcgaattgaaaatcccattatccaccatcacaatccctacatgagcgaggaggacgctagacgcaccggcgagaagatacgacaaatgttttttgatgccaagatgcaactgccacgcagggtcgtcatccacaagaggaccgctttcactgaagaggaacagcgggggttcatacaaggattggaaggcgttgaggacatcgagctgatcgaaattaacttcgaggactccctccgctatttgtctagtaagtttgtaaacagcaagctggaaatcgacgggttccccatcgctcgggggaccgtaatcgtgcaaagcagcaacaccgcgctcctgtgggtgcatggtgcaacccctagcgcgcaaaatccaacgtttaagtatttccaaggcaaacgacggatccccgtgccccttgtcataaagcgctacgtggggcagagcgacattagccagttggcgaacgaaatattgggcctcagcaaaatgaactggaacacctttgactattactccaggcttcctgtaacccttgagagcgccaatgatattgcccggatcggcgtgtatttcaacaatttctcccccatgagctacgactatcggctcctcata

SEQ ID NO: 162 - DNA, 3123 bp, Artificial Sequence
  Description of Artificial Sequence: Synthetic polynucleotide
atgatcaaacacctcaagttcgacgagttccttcgcagcgtgtcaattagtaaggataacacgtactccatgcttatcggtgccgggtgctcaatcactagtgatatccaatctgcctatgactgcatatgggaatggaagaaaataatttacaagtccaataacttgaatactcaggactggatagagaattacaaatcccccaaaacacaagacgtgatacaaaaatggcttgacaaccagggaaacaaccctgagaaagataatatcgaagagtactcattctacgcaaagaaatgctttccgatagatgaaaatagacgccagtacttccaaaaaatctgcgctaataagaagcccagcgtcggatatcgagccattcctctcctggtgaagcaaggcatgctcgactcaatttggacaaccaattttgatgatcttgttaatgtggcgtgtataggtggtggcgttcaggggattgacatatcccttcagacggtaaaccgcataaatcaacgcaatcaaagcaaaaatgaactgcctattataaagctccacggggatttcaagtatggcgaccttaagaacacgagtgaggaacttcagaatcaagacgaaacgcttagatcaaaacttttggactacttgagcgataagaatctcatagtcattggctatagtggtcgggacaactcactcatggagagcttgaaagagacttattcaaaacctggtgcgggaatattgttttggtgtgggtatgggaacagtccatcaaaccaagtgaaggaactccttaaatttatcaaggataaggggcgcagcgcattctatgtttccactgagggattcgataacaccatgctgaacctgaccaagcatgttattgaggacgatgataacctcaaagaggaattcagagaactcaagaagagtatcattaataaaaatacaacgaccccgtttacgttgaacccggaacgaatcaataaggtactgaaaagtaacctctttcctattacattccccaaagagatcttcgtattcaatgcgaccttcgataagaaaccttgggagcttgttaaggaaaaaactctgagtgactatgaaatttcagcgattccatttgaaaaagacatatgggcatttgggactgctaataacgtctacgaaaagtttgcagatatcattaagggcgagatccaacggaagcccctgaccgatatccggctttataatcacaacataaagttcctgctcctgtcaagcctctgcaagctgttctcaaaaacctacaatctgaaaacggactttcggtctaagatttgggatgagagctcatacaaaacggttcacaaccaaaaggtctataacgctataaagatcgatctcgtcaaaatacaagaacagtcatatttgtcactcaatccagactttcaattggcagatgataacgttcccaatgatatcaaccagcaggttggactggaattttttcataagatctataacgacaaatttaacgactatataaacatctggagaaagaagatcctcgaaactacgtcatacgaattgccactgaactccggcaccgggttcgtatttaaaatctctaagaatccaattttcacaaatatagatgaccttaattccaactatacgaacgagcacaatatacccataaacatgattaaacttaagggggttcaattcaaagagacgaacctcctctttagttcacaaaatggagataaagtggttaaggagacccacccaatgagaggcctcgtcaatcatagcccgttcgataagggattgagtagtcttaaaaacactacgatcaacctggggatcgtatgcccccaacaggatagcgaaaatttttatacttttttgaataaacaaaaccaagagattaagaacgttaatattaaggatcaatatgtaatcgattacaaaggatttcacaacacatacggtttgagtctgaacatacctactacgagcagtcctaattgggaaatgactaacgagcctgtctcaagggactcaaagaaaataattcatgaaatcaagaataatatttgcgacaagataaataagctttgtagtataggcggacagaagacaatagtaatatttatccctaaacgctgggacaacttcgtacactataatgatgccgtggaaagctttgatcttcacgattatatcaaagcgttctgtaccgaaaaaaaggttacgtctcagttgatacgggaaaagacgatactcgataataacctcgagtgccagatcaactggtggttgtcactcagttattttgtaaagtccttccgaacaccgtgggtaatcgacaacaccgacaataaaacagcttttgcgggcattggttattcagtagagtccaaaaaagaggataaggggcacattatacttggctgttcccatatttacagtagtaacggggagggtctcaagtataagctttccaaggttaatgataaaatagaatggatcaagaaaaagccgcatctgtcctacgacgatgcttacgaatttggtaaaaatgtgatcaacctgttttacgaaagcatgaatgaggtgccaaaacgagtggtaattcacaaacgcaccttttacactgaagatgagaagcaaggcatacttgactctttgcacgataacaagaaaatagaaaacatagacttgatagaaataaatttcgaagacaacataaggtacgtctcctctaagatatataatcgggaggcaaaaatcgacggttactcagtatcacgcggtacctgtatccttcttaacgaaaaagaggcacttttgtacgcccatggcgtaatcccgagcgtgaagaatccgagttataatttttatccgggaggaaggtacataccgaagccattgaggataataaagcattatggagttggttccctggaacaaatagcaaatgaaatactgggtctcactaagatgaactggaactctctgaacatgtatagccaaatgcctgccacgatcgactcaagtaataagatagccaaaatagggaaactcatagagaatagggataaagtagagtacgattatcggtattttatc

SEQ ID NO: 163 - DNA, 2382 bp, Artificial Sequence
  Description of Artificial Sequence: Synthetic polynucleotide
atgagcgagctggagaccaacatcttcccaatcaccaacttgcatgagcttgaaagcaggttcaggttgtatagggtgaggggcctgagcatcaaccaagaggagtacgaccccaacacccagacattggtgaggaagctgagctacagcatgaggtctcccgtagctgtgatacttaggaacagcgacccgttcctggctcttccaatcgacgcacccgagcccatctctccgtacccgctcgtgagagccactgctgtgttcgagaagacggacgaggtatttactctcgattacgaaagcccaactcccgagacagatgcgctgcgaataaggttcctgcaatttatcatccaaggcgcgctgtttaggaatcccagcctgtggcagccctcagctggcacccccttcttcgagaggagccccgtgttggagaaggccggcatttgcgcgtaccgaggcttctcagtgcgagtcgtgcccatagaaggtggtaaactgggaatctgtgtggacgttaagcacaggtacgtcagcaaaaaccccatcgaagcaaacatcaagcgcgaggaattcaggaaatacaagaacggcaggtgcatataccactacggccacaactggtacgagatcaagttgcaagaccacactgggctgtccgtgtcagagcagatgatcagcaacgggacggccaaacccataagcttgtatcagttcattatgaataacgcgcccaagcccctgcccagggaggtcatagacatgcctcccgactcacccgcagtcaaatacatgaccagcagggatgaggtgcgctacgtgccctccatcctttgttatccggtctttgacacctctgaccccagggtgaagccgacgcataggggcacaatcctcctccctaacgtgaggcgacagtatatccacaatttcgtgaactcacacctgaccgatgtgcgatccaaagacatggcaatccgaatcagcagcaagccagttatcgcccctaccaagattttcctgccgcctgacctggcattcggcaacaacaccgtgttcagcgtaagaggcacacccgggaccacgtatgttagcctggagcagctgggccagacgcggataagcgccctcttcaatcagaaaataggcccttatgacagcaggccgctggataggcagtacatgattctgccgaaaagcgtgtgggactcccacgggccagtatttctgaatgactttaagaaaatcatgaacgagctgtacctgcacgaactgccctacaatcccatcgtcgtgacctacaacgacttgagcgccaagacctacgcgcttcagggaagggctattctggacgccgtggacagcgaactgagagagccgggatacggcgtggttatgatacacgagacggtggaccgccggaatagacagcacgaccagcttgccgcgatggtgatgagggagctgcggaacaggaggctgtatgtgagcgtgatccataccacggtgacgaaggactgttaccaattgccccagaacgcccccattggcaaggcctactgcccggtagcaggcaagcagggcaaactcaatggctacttgaggaacgtggccattaccaaggtgcttctgaccaacgagaggtggcccttcgttatatctaccccgctgcatgcggactttaccgttgccttcgacgtgcagcttaacaccgcttgcttcacattcatcggcaagagcggctccgacatccggaccgttttgaagaccagtaaccaaaaggagaggttgagcaaggcacaagtaaggcagacgctcctggaagtgctccgccaggaggttggcttcggtcgacggaccatgcagaccatagtggttcagagggatggcaaattgtttgccagtgagatcgcgggagcaaaagacgctatagagatagtgaagaaagaaggcatcttgcccagcgatgtgtcactgaatttcatcgaaatccccaagagcagcgtcgccccatttaggctgttcgatagcagccccaggccagggcagcctgaaatggcgaacaacccaagaatcggctcctacttcatcgcgacgaattacgacggttacatttgcaccaccggcaaggagttttaccatcccggtacggcaaatcctctccacgtgaagtacatcgagggaaatatgccatttgagaagatcctggaggacgtgtacgccttgacttgcttggcgttgaccaggcccgaagactgcacaagggaacccttcaccatgaaactggccgatatccgactgagggaacatgccggaggctacgacgaagatgcattggcgtatgatgatgaaaatgagaacgacgaggataacgagaatgaa

SEQ ID NO: 164 - DNA, 2205 bp, Artificial Sequence
  Description of Artificial Sequence: Synthetic polynucleotide
atgaccgaggccttcctcacaaccaggaggggcttcgtgcaaaagctgacgctgaccaggtacgattacctgaactggatcatcgagtccgaggcgcagaaagccaagctgaagaactggcttaagaacaagagcgggtttctgacccacgagatcgaggatacctgtttcttcaccttcgagaggcttctggaggagagtactaagcagtatagagcctccggcgagaaaactctgtctgccccgttcaagaacacgcaactgatctcaaatctgatcggtaccatattgaaaaaggagttgagcaagaaatacaagcaattctttagtcaaaacatcttcatcgtgagcaccatcgatctgtatccattcaatctcttgaaggcgttcgagttcaacatcgaagtgtttgacagcggccacttccttatccacgtcaacccagtgtctaaaattgtaagcagcaaggttgtggacaaggagtatctggactacctcaagaaaagcaacctcaacaacagcaaaaccaccgagatggagttcgcggtgatcaaccatgaaaggaatttcagacttaaattcgacctgcttgacgaatgcatctttgagaagatagagaagctgcacagcgagaagaatatgtttacagccacttttgattaccatttcctggccaacttcagccccgagatcttcggcaaaatcgtggaacatactagcaaggatctgaagcaggccatcatgttcctgaatgacatactgagcaatatcaagctgccgagctttctcaacctgcacgaggaacgatactttaaggtcaatatctccgaattggaccgaaagaataatcttctgattggaagcagtttcgaggtaataaccatatactcaaaaagccagacccagtatggactgaggattgagttcactcgcgacagcataagccgggacgagcttataacaatctttctgaaaaacgaagagctgatcgagaaactcaacgacattaaagtggtccccgccaccatcaacgcaaaaatcgaacagaagaccggctggaaaaacccctacatcaccaatgttttcatcgataacgtgggtgccttcagcaccagcagcctgcaaagcgcctcatacttccacggcatctacaaggccgttaacaactggaatatcctgcccatcgtgtacgaggacctcgacatcaaagtattcgagaacctgatgctgcacgcctttaacaagaacgccaccgaattcaagatcctggaacccatcataatcaagtccacgaacgaaatcgacaaacaggaggtgcagaggagcatcaaaaaccaggccggcaagaccatgatcgcagtgttctgcaagtacaagataccccatgacagcttcgcccccctcaagggcttcaagtatcagatctatcaaggcgacaccacggacaataagcagaatagggccaaactgagtaacttcacgtgcaagtgcctggagaaaatgggaggggtgattgcggcaatcgcggacacaagcatagccgaggatggatatttcattggcatcgaccttggccacaccacaaatggcaaggaaaagttctccaacctcggagtgagcttgtttgatagcctgggcatcctgttgggcgattacgtggagaaggagattccaagaagggaaaacctcatcgacacgaactgcctcaatgcttttaagaaacttgacaaaatgctggaagctaaaaaactgaacaagcccaaacacctgatcatccatcgggacggcaaactgcacttcaaggatatcaacattctcgtaagctgcgtggaaaccgtgtggggtaagataaacgtcgatatagtcgagatcattaagagtggcttccccgtgatggctataaaggacgagaccaacaaaccaatcaatcccataagcgggaccagctaccaggacgacatccataagtacgccatactcgccacaaacgtacaagccgacgaacagtcagccgtaataaacccgataatcataaaacacaaatacggagagctggagtttagcaaaatagttgaacaggtgtactggttcacgaaagtgtataccaataacctgtacaatagtaccaggctcccagcgactacactcaaggccaacaacgtggttggcacgtctaagaagctccacagaagtacatacttgggc

SEQ ID NO: 165 - DNA, 2184 bp, Artificial Sequence
  Description of Artificial Sequence: Synthetic polynucleotide
atgttcgtggaactgaacgccttccccatcgacatccgcaatatcggtatcgtggaggcctgcgaggtgccgtacgacaaggaggtgctttatagcctgcatgataacccacaaaaagattaccatgctatcagaaacggcaaccagatattgatattttctaatagcaaaaactaccccatccagggtacaatcaaggagataaatcttgcacaggactaccgcatcctgtttttccttattaaggagtccattatcaagatcctgacgcagatcaaacgggagcctttcaagttcaacccgattgagttcatctcaccaaaggagaacatcaccgagaatatcctgggaatcaattacccatttcaaataaacgccaaatattcaatcgataccagaatcattcagggggtgccctgcctcaccattgattgcagcacgaagaaatacaacaaggaatccctgatctacttcattaacgacggcttcaacctgattaacaggtacgtgatctcaaagcaaaacgagaagtataagcgcgtaggtaagatactgagcattgacaacaacatcgtgactgttcagagctgcgacaagataaagaagtactccgccgaggaaatcaccttggaggcgaactctaagaacaccaaggactatctggcatacaagttcccctataagttcgagcagatccaagaaagcattaagaaggcgatcagtaccttcacccaggggacctctaagcagataaacattggcaagatctgggactttttcagccagaaaggcatcttcctgttcaacggccaccgaattaacatagggctgcctcccgacatctcccagcaatgcaagaaccttgtgtacccgcgctttttctttagcaactcccgagaaaacaattccaaagagaacggcctgaaggattatggcccttacaccaggaattactttgacaggaataaccccagcatttgcgtgatttgcaacgctaaggaacaaggcaaagtggaacagttcctgcacaaatttctgaagggcatacccaatagccataactttaagacgggcttcgagggcaagtttcatattggcctctctcagatagaatttttcacgaccagcgacgacagcctgggcagctaccagttggctatccagaaggcaatccaaacgaggactaaccaaaactctagccagtgggacctggccctggtgcaaaccaggcagtccttcaagaaattgttggtggagcagaatccgtactttattagcaagaaaatgttctttcagcatcagatccccgttcaagacttcaccatcgagctgaccaatcagaacgacaaaaacctggagtattctctgaataacatggctctggcgtgctatgcgaagatgaatggaaagccctggctgcttaaatcaagccctactatcagtcatgagctggttattggcatcgggagcagcaacatcatcatcgaggaggacagtctgaaccagaggatcatgggcatcaccaccgtgttcagcggcgacgggtcttacatggtctcaaacactagcaaggcggtggcgcccaatgagtactgttgcgccctcatagacacacttgagcaaacgatcaagaagctggagaaacttatgaactggcagagcaatgacaccattaggctcatctttcatgccgccgtgaagaccttcaacaaaaatgaaatcctcgccgtaaaggaagtgatcaaaaagtatagtgagtacaagatcgagtacgcttttctcaaaatcagcagcgaccacggtctgcacctgttcgaccactcaactaagaatgagaataagggtaaattggctcccaagaggggtaagtattttgaactgagtagccatgaaattttgctgtacctcgtggggcagaaagagctgaagcaggtgagcgatggccacccccagggcgtgatcgtgtccctgcataaggacagcagctttcaggaccttaagtacctctctaatcagattttcagttttagctcccacagttggaggagctactttccctctcccctgcccgtgacaattcattatagcgatctcatcgcggagaacctgggctggcttaacaagctgagcggctgggacgatacaatcctgctgggcaaacttggacagacccagtggtttctg

SEQ ID NO: 166 - DNA, 2022 bp, Artificial Sequence
  Description of Artificial Sequence: Synthetic polynucleotide
gtaaagcttaatcacttccccctgaatcccgctcttgcagtgttcaagactacctacaggcacagaaaccccaggggcttcctgggattcgttaggtcacaagggttgaccgcggagagagttggcgaggaagtgtgtgtctatcacggtcttccccacccggcttttagaggagccaccgcccaaggacacaccagactggcgcctggtgacaccgattacgacaggggcgtacttagtctgatcggagccgccctgctgaaagcgggttacgtgcttactgagcgcgaaagggccgcagtgcaccccacgcagcagagagtgcccctgcacacccctaggaaactccctgccgaaattgcggtgaatgcccatcttcgatgggaatgggaactggaacggcacagcgggaagtcttggcttgtgcttaggcccggacgcatgtttttgagtgcgctgagctggcacgatttggacctgagggcatgggcacaggagttgccccagagcgtacagcaactgcacgcgctgtgtcttcgctccggacgacgagaacgactgaggcgcatgggtaacacgtgggcgttccaacgagaggatagggagcaagagggcaggtggcacctgagctttagcactaaggcgctttccgacctgaacctgtccggcgatgctcaccatgctgctagcctgagcatgcccgatgtgcagaggctcgtaaatctgccgggtctgtggcagccctttgtgacaagccttgaagtccttgaggtgcctggtaaggtgatcgagggcaaaaggctgaggttcggacgaggaacagggcgcgacgtcacggatgtacacaaaaggggcatccttcaccctccgccgcagccagtgcgccttgcggtcgtgccccccattcaggcggacgaagaggcggatgagcagttgagacgcgagctccttgcccacctcctgccacgggaaaaggtgttggcccaccccgaggcttcccagggcctcaagaagcacttgaatcgaagggaaaccgacgacaccttctacaccctgtggagcgctggagactactgcaaactggggctggaaccctttgatctggtgcgcgacctccataggtacgaccccggcacgggtcgcctgctggctccagagaagttgcatggagcagcagccgccgcgagagaggctggcaggcaattgattggcctcgtgatcctgcccgacaccatagggcgagatgagagggacgcactgtccgacgaactggccaagctgggtgtgaagaaacttcagcacatccgcagggacatgctgaaccggcccaggacgcagtatatggcctgggtgaacgtggccgtgaagctcgcccagagggccggagcagtcagctgggacctggaaaagttgcctggagtgtgcgaacagaccttcttcgttggcgtggatctgggccatgaccatcgggagaagcaaagcgtcccggccttcagcctgcacgagttccgaggcaggccggtcgactgcctcacccttccaaggcgagccggaaatgaaaggttgagcctggcggagctgaatcaaggcctgaggaagctgcttaagggtaagaggccagcccaagtgatagtgcatagggacggcaagtacctggagggggaggttgatgacttcataatcgctttgaacgacctcggcgtgccgcgcgtcagtcttctcgccgtcaaaaagtccaacctctccatggttgccggcgctaaggagggagcgtttttgccactggacgagcggcggtgtctgctggttaccaatacccaagccgcggtagctaggccgacagagctggaggtgatgcactcagatcatctgactttcgccgagctgaccgagcaagtgttctggctgacccgagtattcatgaacaacgcacagcatgcgggtagcgaccctgctaccgtagagtgggcgaacgggatcgctaggaccggaaagagaattgccctgtctgggtggtccgcc

SEQ ID NO: 167 - DNA, 2229 bp, Artificial Sequence
  Description of Artificial Sequence: Synthetic polynucleotide
atgctcgactttagccttacccagaaaggttgggtgctgcccatcgtactgaacgcctttccgctcaaggtaccggacatggagctcaaattcgtgcagatcccctacgacaagacgaccctggactcactgaggtcaagccacaagatgacccacgtcttcaggaggcaaggcgacagtatccagatcttttctagcgacggcacctttccaaagagcggcaccccccagaccctccaactgaaggataatctgggaatctttttctctcttgtaaaggacggcctcctcaagcacttcgccggtttgggccgaaccccgtgcggattcaaccccattgaggtcgtgtcagctcaggccaaagacaatcttctggctagcatcctcggagaagcctacccgctgaaaatttgcgccaagtactccatcgacaccaggacagtgcaaggtcaaccgtgtctcatcatcgactgcagcactaggagagtggttaaagagaactgcctcttcttccttaagaccggctttaacgtgattggccgctatgtagtgaccgagcaggacgacgggtttcggaagctgctgggttttgtggaaaactgccacgaaggcaggacactgagcgttataaggccagatggccaagccgtgcatgccgaggccaaggacgtgtatctcgaggcatctagggccaacttcgacgactacatcctttatacgcacggaactaaaaaggatagcatcgtggagcgaatcagacaaagcgtgagtatcttcaacggcggtaagaacaagaaagatagaatcgacgcgctcaaaaagtacatccaggccaccaatataagccttttggatgggaccaggatcgaaatcgaggagcccagcgacattcagaaggactgcgcccagatgcagaagcccgtgtttgtgttcaatgacaatggcgaggccgactggaccgagaaggggctgactcagaacggcccctacaccaagcgcaccttcgaccgaaacgaccccagcatctgcgtgatctgcgcacaacacgacagggggcgagtggagcagttcgttaggaaactgctgaaaggcatggctaacagcaaatacttcagaaacggccttgagggcaagttcgcgctgggaacgtcccgggtagaggtgtttgagaccagcacaaatagcgtggacgcctataagagcgcgatcgaagccgccatccgcaagaaggccgatgacggcggcaggtgggacctggcattggttcaagttaggcagagcttcaagcagctgaaggtgactgacaacccctactacttgggaaaaagcctgttctacatgcaccaggtgccagtgcaggatttcactatcgagctcctgagccagtccgactattcactgggctacagccttaacaacatgagcctcgcttgctacgccaaaatgggaggagtgccctggctgctcaagtcctctcccacccttagccacgagctggtgatcggcatcggcagcgccaacattgtccaggagaggggggcacacaaccagaggatcatggggataaccaccgtatttagtggcgatggcagctacatcgtcagcagcacgtccaaagctgtggttcccgaagcatactgcgaggcgctgactagcgtgctgggcgagaatatcgaaaaaatccaaaggagaatgaattggcaaaagggtgactcaatccgactgatcttccacgcccaagtgaagaagttcaacaaggaggagattcaggcagtgcgagccgtgatagacaagtatagggactaccagatcgagtacgcttttgtgaaaatcagcgagaaccacggcctgcacatgtttgacagctcaaccgccaccatgcccaagggcaggttggccacacacaggggtaagacctttaagctgtccaaaaacgagatgttggtctacctgatcggacagagggagctgagacaggaaaccgacggccaccccaggggtgtcatcgtgaacgtacacaaggacagcactttcaaagatatcaagtacctgagcgcccaactgtactcttttgcgagtcattcttggaggtcatacttccccaaccctatgcccgtgaccatcacctacagcgaccttatcgcccacaacctcggctggctgaaccagctgcccgggtggtctgacagcgtaatgataggtaaaatcggtcatagccagtggtttctg

SEQ ID NO: 168 - DNA, 2805 bp, Artificial Sequence
  Description of Artificial Sequence: Synthetic polynucleotide
atgttcgacattggatcaatggtgagagttaggggtcgagactgggtcgtgttgcctggcagttccgcagactttctcctgcttaagccactcggcggatcagatgcagaaacgacaggggtttatgccggtcccggcggcgaagttgtgagatcagcgacttttgcgccacccgatccgcaagcgtttggaacagcctctggcgctcggcttctcctgaatgcagctagattggccgttaggtccggcgctggaccgttccgctcccttggcaggctgggggtagaaccacgcccatatcaacttgtccccctccttatggccctgagacaaagtaccgcccggctccttattgccgacgatgtaggtataggaaagacagttgaagcggcactcatcgccagggagctgcttgaccgcggagagatagagcgattcgctgtgctttgtccgccccatctggctggtcagtgggtaggtgagctgaggagcaagtttgggatagatgccgtcgcggtcctccccggaaccgcgcgaagactggagcgcggctgtaacccaggccaatctgtgttcgccagataccctttcgcagttgtctctctcgacttggtcaaatcagaccgatggcgccaggattttttgcagaacgcccccgagtttgttatcgtcgacgaagcgcacgccagtgctgagggcgaggggttgggcgcgcgaagacatcagagatatcgccttttggaggaccttgcgcgagacccagagcgacacttgatactcgtgacagctacgccacacagcggaaaggaggacgcattcagatcccttttgagattgctcaaccctgaattcgccgctctgccactggatctctccggcgctcaaaacgaaagagctcgggcagctatcgctcgacacttggtgcagcggaggaggggtgacatcactgcataccttcacgaggacaccccatttccagtccgaagggacgccgaggttaagtatactctgcaccccgattatgcggcattgttcgaggacgttctggcctatgcaagggagtccgtgcacgttccaggcgaggcgcatagtcggacgcggatacgctggtgggccgccctgggactgcttcgggctttggcttcttcaccccaagcagccgcagccactctccgggaaagagcaagcaccgaaggcgagactgatgaagcagttattgaaagacttggcagggaactggtgcttgaccccgaagacggtgaacatgggctgctggacgtcacccctggagcgcaggtcgacggtgaagaaagcgggaccacgcgacgccttctcgcactcgcagagagggccgacgctctggctggggccaaagaccggaagctcgcactcctgaccgcacaggtcagggatcttctgcaggaaggtttcgcgccgatagttttttgtaggttcattgcgaccgcggaggcagtagcggagcacttgaggggagttctgaaaggagctgaagtcgtggctgtcacaggaaggctgacgccagatgagcgcgtcgcccgcatcgaagagcttgcaccccacgagcgacgggttcttgtggcaacggactgccttagtgagggcattaatctccaagctgccttcagcgcagtagtacactatgatctcccctggaaccctaccaggctcgatcaaagggagggccgaattgaccgatatggtcaacgatcaccagaggtccgagtgcttacattgtatggggaggataacaggatagatactctgatactggatgttttgatccgaaagcatcggctgatccgggctaccttgggaatgggtgtccccgctcccgacgaggcagaaggattgcttgacgtgctgttggcgcgagtactggaacccgaacgaagaggttctattcagccattgcttctggatgaagtgcaggcttttgatttgaaatggcgcgatgcggctgaaaacgaaaaaaggtcaaggtcacgattcgcccagaactctataaggcccgaagaagtagcaggggaactcgcagcggtacgggaagcgctcggagacgctcgagccgctcaggacttcgttcttgatgcactgcgaggggccggtgttcaggtgacgccgcgccccgacggaagcttcgaagcggaccccacccaagccgatgtagcaccggaggtccgcgactttctgcggggagcaaggcgcttcagatttgacgcacgggtagaacgaggtgtgacgcccttggcgcggaaccacccattggtcgagcaacttgcaagcactgtactgggtcaggctctggagtctccgcaggaggccgcagccaagcgcgtaggcgtcattcggacctctggcgtaagtactcagaccactcttttgctccttcgatggagatttcatctttccggacgaaagggaaaccgatcttggcaaactcttgctgaagaacttgatcttctggcttacgcaggaagggcagaggatccgcagtggttggacgctgaggccaccagagctttgctcgatctgacccctcagggtaacttggatccggtgcagaaagaggaacgccttactcggacgcttgagggacttagcgctttggagggggttttggaccagcgaggaagggatagagccgcagctctgcttgacgctcacgagagagtacggggagcagcgcgagggcaaggggtgacctattctgcggagcctcctggccccccggatctgcttggtgtctatctctttctccccgcaccaagactcggaggcctcgcc

SEQ ID NO: 169 - DNA, 1668 bp, Artificial Sequence
  Description of Artificial Sequence: Synthetic polynucleotide
atgatagccgtggaagagtggcaacctgcggacggactgacccttgagcctaatgcaaagagggctgcgaaggctagaaagaggtgcctggccctgacagcgggtcccggtgccggaaagacagagatgctcgcacaacgcgccgacttcttgttgaggaccggaacctgtcggtaccccaagaggatactggccatctcattcaaagtggatgcaagtagaaacctgaaggacagagtggagaggaggtgcggctatgatttggcgtcaaggtttgacagttatactttccacgcgttcgccaaaaggatcatcgaccgctttaggccggtgctgacaggcaaggacgccctcgacgcaggctacaccatcgtggataagaagaatggcccctctaggacccagatcgagttcggcgaccttgtcccccttgccatacaaatcctgcaatcaagcaaaattgcacgaaacgcgatccgccaaacttacagcgacatcttcctggatgagtttcaggactgtacaaacctgcagtacgacttggtaaaacttgcgttccagggtacgtcaatacggctgacggctgttggcgataccaagcagaagataatggcctgggctggagccctggacggcattttccagacgtttgccaacgatttcaacgccgtgtccctgaacatgtataggaatttcagaagcaagccacaactgctcagggttcaaaatgaaattatcaggaagttggaccccgattccgtgatgcctgacgaacaacttgacggtgatgaaggcgaggtctatgcgtggaggttcgaggatagctgcaaggaagccgtgtatcttgcggaccttatcaatggctggatcaacaccgaacagctgcccccagcggagatcgccgtactggtcagcaaacagctcgacctctatgtcgaccacttgatgactgagctcgaggctcggggaatcccctacaggaacgagcagcagcttcaagacatcaccatagagccggcagctagactcattgtggactacttgagttgcctctacggcaagagagagccgaaagcatggatccggctcatgaaccagctgatcccattcgcggacgaggagatccaatctagtgctcgaaaggacctcgaccagttgataaagaagcagagaaaaagggtgagcgacgcgaagcacaccgattcacctttcagcgattgggcacaactcgcaattgaattcctgaagtacataggcagtaagatgctggtggcactgagtccagattacgagacgcgcgagaggctgaatgacgtgatcagggaaactttcgcgaggatcaaggaactgttgaagagcgagcccgacctgcccaaggcgctgggccggtttgccgatgaccaggcggtgcgaatactgaccatccacaagagcaagggcctggaattcgacagtgtgatcatcatggccgtcgagaacgagatattcttcgggaaccaggacgagaataggtgcgctttcttcgtaggtgtgagccgagcaaaaaggaggttgatacttacccacgccgaccagagggaaaggccagcgtctgccaagcgatggaatgttagtagaaccgctcagactgagtacattagttacgtcacccctttcgtgaggccacag

SEQ ID NO: 170 - DNA, 2502 bp, Artificial Sequence
  Description of Artificial Sequence: Synthetic polynucleotide
gtggccgctttgaagcgctactttaatgacaagaacctgatcgtgataggctactctggcagggacaagagcctgatgagtgcgcttaccgaggctttctctgagaagggctctggccgcatctactggtgcggctacggcagccacatttcccccgaggtggaaagcttgttgaggaccgcgcgagaggcaaaccgcgacgcctactatatcgacaccgatgggttcgacaaaaccatgttcagcctggtaataaactgcttccaggcggatatcgaaaagaagaaagagataatgagcatcctggagtctgctcccgaggacaacgataccagcccgttctcaattcacatcaccaggacggataaataccttaagtccaacctctacccgatcatctttcctaaggagctgtttcagtttgagatagaatatcatgagggcgaacgaccatggaccctgctgagagagatcaccaaagaccagaacatcatcgccgtgccctacaagcaaaaagtctacgccttgtcaacgggatcagctatcaacaacgtgtttggtagccggttgaaatcagatatagagaggattcccgtgtctatggatgacattgagcgcaagtctagttacagggagctcttcctgagggccacccttcagtctatagccattataaggggcctgaacgtggacatacgacacaataccctttggcggagcgacatctttaggaacgacaatggcaccctcatccacgaagcgatcgagtgttccctggtgtttgtgccccaacagaagtatgccctgttgagcttgaggcccaccatctacatagagaactctcatacggttagcaaggagaaaaagcaggagtacgccaggatctacctggataagatgtggaataaagcgtacagcacgaagttggcccagtgggaatctataatctttggagacacgaggctcgccttcgaggtgccgcaaaattcaggatccgggtttaagtttctgataagccacaactgcggcttcagcgaaatccagtatcaagacaacaccgaaaggggatacagtagcaagagctacgacaacaagaggacgatctataggggcttgcagctgaaggaacccgagctggaatttgtcaatacgtttgcagaccggcccttcctggacagcaaccccatgcgaggcctgagcaatcacaggccgtacgacagctggcagaaagacgttctcttgcagaacgtgcggttgggcgtgatttgcccgaacacgcacaccgaccgattccactcttttctgcagcagcttaacaccacaattcaagccaatgacgatagcgactacattcagtcctacaccggtttccatagcatttacaagactctgctggaaatccccgataacgggaccgacaaatggataaacatcgaggatacccccaaggacaccatcagtctggttcagagtatatgtcaccaagcgaaccgactggccgacaagtacccgggcatcgtggtggtgattttcatccccgcattttggtctatccatcgacagttcaaacacaacggggagagcttcgatttgcacaactacatcaaggcctacgccgcacaacatagcttcactacccaaatcattgaggaaaagacgctgcgcgaccacatggtctgcgaaatttgttggtggctgtcactcgcactgttcgttaaggctatgcgaatcccgtgggcactggccaatttggactctgacaccgcttacgcgggtatagggtactcagtgaagaccaacagcaaaggcaacgtcgacatagtgcttggatgttcacatatatacaacgcaaagggccagggtctcagatacaaactctctaaggtcgagcagccccaattcgatggcaagaaaaatccttaccttacgtatgaagaggccttcaagtttggaattaccatacgcgagttgttcgtcaaaagtatggaccggcttcccaggagggttgtgattcacaagcggacgccgttcaaaaaggaggaaatagagggaatcactcacgcgttgactcaggctggcattaaggacatcgatctcattacgatcaattacgagtacgacgccaagttcatagcgcagaaggtatactatgacaacatcagcgacgattcatatcccgtaagtaggggcacctgcatcaaattgtccagccgaaatgcgctgctgtggacacacggcgtggttccctcaatccgggagagacgacgctactaccccggtgggcgctgtattcccgcacccctgaagataacaaaatactacggtaaaggcgatcttccgacaatcgccagcgagattattggatttactaagatgaattggaacagttttaatctgtacacgaaactgcccgccaccatagatacgagcaatacattggcgcaggtcggcaatctgttgcatcagtataacggcgcaacttacgactaccgatatttcatc

SEQ ID NO: 171 - DNA, 2289 bp, Artificial Sequence
  Description of Artificial Sequence: Synthetic polynucleotide
atggtcgcgctgaggctgaacggcgtacccatcttgtgcgccgctgacgtaaccgtggccgtggcgaagttgccgtacacgaaggagagcctggacgagttgaggaaggagcatgcggggaggtatttgattaggagaggcggagatgacgggcaggaaatcatgtctgttcccttgcttgctgatgctccgcagctgagcgatgccgttgtggaagttaagctgtcagaagcccactggttgctcgcctcactcgcggtggaggccctcaccaggttgttcacagaacttggtagacctatcctgcggtcccggccattgcggctgctctcccaaaagccggccaatctttttccggagaacgtcggactgccagactggctgcaaaggagggttgtgctggatttggagactaggaagatctggcggcaggatggagacccgacattggtgctgctgtgcgatgtgcggactcaaaactttatcgacgtgccaacggataaactgatggccaccggcgtaagcgttatgggtcgctacgttagccgaatggtgagctctgatgatccccggatcacctcacatctgaagctcgccggcagggtcattagcatagagggcgaccgactgctcctcgccgactttggcgagggaccggatagtataagcattgctcatgcctatctggagagacgacgggaaaatgtcgactggtgtgttcaacagctgaaccccgcgaaagcagggcaaatcctgatgagcgtgcaggccgaggctgcgaaattcttgaacggacctggccgattcgagctgatcaagaggacattcgattacctgcgcacgcagagtatagagcttgtgcccgacgtgaagctggagttgggggacttgattggcatgggagccgcacgctggcccttccgccaggaaacaattaagaagcctaccctggtgtttgatccgtctggtgtcaagaccgatacctggaacgagcgagggcttgacaaacacggaccctacgaccagaggaccttcagccccaaggaaatgaggatcgccgttatctgcagggaagcagacgaaggtcgggttgaaggatttctggccaagtttctggacgggatgccacacgttatcgtcggggagaaccgaaaaccctatgaaaagggattcataaggaggttcgccctgagtgccccgaaggtgcacactttcaccgctaagtcttctagtgtgccggactacctgaatgcgtgccgagcggccctgaagtttgcccacgaccaaggctttgaatggagcttggcaatcgcgcaaatcgacaaggactttcgggaactcctcggtcctgacaatccctacttcgcgatcaaggccgcgtttctcaagcagagggtgcccatccaggagttgacgctcgagacaatgagcacccccgacaggcagctggtgtacattttgaataacataagcctcgcaagctacgccaagatcggcggcattccgtggctgcttaagagcggtcctaccgtgggccacgagctggtcattggtattggtagccagaccgttagcagtagtcgattgggcgagaagcaacgggtggtgggcattaccaccgtattcacccacgatggcagataccttttggacgacaggacgcgagccgtgccatacggcgagtacgaagcagctttgtccgagacgctgaccagggccatagagagggtaaggacggaagataactggaggtcaaccgacgcggtgcgacttgtattccacgtgttccagcaaatcaaagactacgaggccgacgcagtggggaaactggtcgagaatctcggcttcagcgatgtcaagtacgcctttgtgcatgtcgttgacagccacccctacaccctgtttgacgaacacatgccaggcgttaagtttggctacgagatgaagggcgcctacgcacctgagagaggcctgtgcatcagtcttggcagggacgaacgcctcctcagctttaccgggtctagggaggttaaacaaacccatcatggcctcccaaggccaacccttcttcgactgcataggaacagtaccttccgggacatgacctacatcgccaggcaggctttcgacttcgcaaaccactcatggaggatgctcaccccagcgcccctccccatcaccatccactacgccgaactcatcgcccggttgttggctggtctgaaagacacacccggctgggacgaggacacaatgctcggcccagtaggtagaacccgatggtttctg

SEQ ID NO: 172 - DNA, 2241 bp, Artificial Sequence
  Description of Artificial Sequence: Synthetic polynucleotide
atgaactacacagccgccaacacggccaacagcccattgtttctcagcgagattagcagccttaccttgaaaaacagctgcctcaactgcttcaaactgaattaccagctgactcgcgaaataggcaataggttcggctggcagttcagtaggaagttccctaacgttgtggtggtgttcgaggacaactgtttctgggttctcgctaaagatgagaagagcttgccctctcctcaacagtggaaggaggctctgagcgacatccaggaagtgctgcgagaggatatcggagaccactactacagcatccactggcttaaagacttccagatcaccgccttggtgaccgcccagctcgccgtgcgaattctgaaaatcttcggtaaattcagctaccccatcgtgttccccaaggacagtgaaattagtgagaatcaagtgcaagtaaggcgagaagtcaacttctgggccgagatcattaacgataccgaccccgccatttgcctcaccatcgaaagcagcatcgtctattccggcgatctcgagcagttctacgaaaatcacccgtacaggcaagacgccgtgaagctgctggtgggcctgaaagttaagaccattgagaccaacggcaccgctaagatcatcaaaatcgctggcactataggggaaaagcgcgaatacctgttgactaaggccacgggaagcatatcccggcgaaagttggaggaagcccacctcgcacaacccgtggttgcggtgcagtttggtaaaaaccctcaggagtacatataccccctggctgccctcaaaccttgcatgaccgacaaggatgagagcctgttccaggtcaattacggcgacctcctgaagaaaaccaagatcttctacgctgaacgacagaaattgcttaaactgtacaagcaggaggcgcagaagactttgaataacttcggttttcagcttcgggaaaggtccatcaatagcagggaaaatccagacttcttctggacgcccccaatttcattggagcagacccccatcctgtttgggaagggtgagcgcggtgaaaagagggagaccctcaagggcctttcaaagggcggagtctacaaaaggcacagggagtacgttgatcctgccaggaaaattaggctggccatccttaaaccggactcttttaaagtgggcgacttcagggagcagctggagaagcgactcaagctgtataagttcgagacgattctcccccctgagaaccaaatcaatttttctgtggagggtgttgggagcgaaaaaagggcccgactggaagaagccgtagaccagttgataggtggcgagatccccgtggacatcgccctcgtctttctgccccaggaggaccggaacgcggacaacaccgaggaaggctccttgtatagctggatcaaaaagaaattcttggatcggggggtgataacacagatgatatatgagaaaactctcaacaataagagcaactacaataacatcctgcaccaggtggttcccggcatattggcaaagctcggaaacctgccgtatgtgctggccgagcctcttgaaatcgccgactacttcatcggcctggacgtcggaaggatgcctaagaagaatctccctggttcactgaacgtgtgcgcgtccgttaggctctacggaaagcaaggtgaattcgtccgatgtagagtcgaagatagcttgaccgagggggaggaaatcccccaaaggattcttgagaattgtctgccgcaggcagaacttaagaaccagaccgtcctgatctacagggacgggaaattccagggtaaggaggtggaaaaccttttggctcgggcacgagccatcaacgccaagttcatcctggtagagtgctacaagaccggcagcccgagactttacaatttcgaacaaaagcagattaatagccccagcaaggggctggcgcttgcattgagcaaccgggaggtcatcctcatcaccagccacgttagcgaacagatcggcgtgcctcggcctctccgcctgaaggtgcacgaactgggagaacaggtgaacctcaagcaacttgtggacacgaccctgaaactgactctgctgcattatggctctctgaaggaacctcggcttccaatccccttgtacggagccgacgccatcgcgtataggaggttgcaaggaatctatccaagcctgctggaggacgactgtcagttctggttg

SEQ ID NO: 173 - DNA, 2241 bp, Artificial Sequence
  Description of Artificial Sequence: Synthetic polynucleotide
atgaactacacagaggccaagaccgccaatagccccttgttccttagcgagattagtagtttgacacttaagaatagctgcctgaattgttttaagctgaaccatcaggtcacccggaaaataggcaacaggttctcttggcagttcagccacaagttccctgacgtcgtggtagtgttcgaggacaattgcttttgggtgctggctaaagatgaaaagagtttgcctagtccacagcagtggaaggaagcactgtcagacatacaggaagtgctgagggaagacattggggaccactactacagcattcactggttgaaagacttccagataaccgccctggtcaccgcgcagctggctgtgcggattttgaagatatttgggaagtttagctacccgatcgtgttccccaaggacagtcagatctctgaaaaccaggtgcaggtgcgaagggaagtggatttctgggctgagataatcaacgacacggacccagcaatatgcctgacggtggaaagcagcatcgtttactctggcgacttggaacagttttacgaaaatcatccgtaccgacaggacgccgtgaaacttctcgtagggctgaaagtgaaaactatcgaaaccaacggcatcgcgaagattatcaaaattgccgggaccatcggagaaaagcgggaggaactgctgaccaaggcaaccgggtccataagcaggcgcaaattggaggaggcacacctgggccaacctgtggtggccgtgcagttcggcaagaatccgagagaatacatctatccccttgccgcgctcaaaccgtgtatgaccgacaaagacgagagcctgtttcaagtgaactatggcgagcttctgaagaagactaagattttctacgccgaacggcaggagttgctgaaattgtataaacaggaggcgcagaagacgctgaacaacttcggcttccagctccgggagcggtcaatcaatagcagggagaaccccgactttttctggaccccctcaatttcccttgaacaaacgcccatcttgtttggcaaaggtgagcgaggtgagaaacgagagaccttgaaaggcttgagcaaaggcggcgtgtacaagagacatagggagtacgtcgaccccgcgagaaagattaggctggccatcctgaagccggccaatctcaaggttggggattttagggagcagctcgagaagcgactgaagctctataagttcgagaccatccttccccccgagaatcaaatcaattttagcgtagagggcgtgggctatgaaaaacgagcccgcttggaagaggccgtggaccaactgattaggggggagatacccgtggatatcgctcttgtctttcttccgcaggaggaccgaaacgccgacaacaccgaggaggggagcctttactcatggatcaagaagaagttccttgacagggttgtgataacgcaaatgatctatgagaaaacgcttaactataagaacaattacaagaacatcctcgatcaggtggtgcctggaatccttgcgaaacttggtaatctgccttacgtgctcgcagagccactggaaatcgccgactacttcattggcctggatgtgggtcgcatgcctaagaaaaacctccccgggtcacttaacgtgtgcgcgtccgtaaggttgtacgggaagcagggcgagtttgtgcggtgccgagtcgaagatagtctcaccgaaggtgaagagatcccccagagaatcctggagaattgtctgccccaagccgagttgaagaaccagaccgtgctgatatacagggacggtaagttccagggcaaggaggtggataacttgctggcccgagccagggccattaagagcaaattcatacttgtcgaatgctataaaacgggcatccccagactgtataacttcaagcaaaaacagatcgacgcgcccagtaagggcctggcgttcgctctgagtaacagggaggtgatcctgatcacgtcccaggttagcgaaaagatcggcgtgccgcgacctctgaggcttaaggtacatgagctgggagagcaggtaaatctgaagcaactggtggacaccacactcaagctgaccctgctccactatgggtctcttaaggacccgaggctgcccatccccctttacggcgctgacatcatcgcgtataggaggttgcagggaatatatccctctttgctggaggacgattgtcagttctggctg

SEQ ID NO: 174 - DNA, 2523 bp, Artificial Sequence
  Description of Artificial Sequence: Synthetic polynucleotide
atgactaacaaaaccaaacaaaaaagcaggaagcagaggtccctcatagaatttcttaaggtgaagaagatcaacaaggaagatggtaagaaccataacctgatcaagtatagcaccgaacggatcgatacaggagtgacccagagcctcattgacatcaatatatccagtaacatccttaagctgcggggcagcattgctcaagaggtgttcaaacggaaaattggcgtttactacgggcttgggaagtattacgttgccgaaaacaagctgaagaacaccgatcgaatggatttcttgaagagggtctacgagaccttcccctataactacctcgataaacaggacccgcacagcaagatcagcttttacgagtactacacattccagaagtccatcgacaaagacgtgataaacctgcttgagctgcagaagataaacgagtatagttgggacatactggacccacacatcgccacgcgccttctcacaagctatgtgaagctttacttgggcgactacttgaagccaatcctgtcctctttcgagtacgtccgggctcgaatcaagacaaagcaaaagaccgttccaatcaaaatccccgtgaccaagaagttcgagatccgaactttggggtacgacccgacgcagagcgaaattactctcgccataaaacgacacgccagcatgaacgctgtgctgttgagcagctttccccccgacatcctcgcggttgtgataactaagctcaaacgcctcgtgaacgaggccgtgaagcaagactaccgaaaggtcagaatatactccgagacccagccggggagcggtactgccgcagttgttgaaatcatcagcggcagccaaaacgtgatgaagtttctcgaagagcatccgaagggggccatccacgttgaaaagcgacttaaagagctgggtaaatcactgcaggaggtccggtaccttcttatcggcgtctatgacaacaacgtcagcctggagcgggcaaaaaaagacgaaagataccactactacttcaccgagcataacgcttaccttgtacttacgcccgaggtgcaaaaggcgctctttggcaagttgatcgacgactggaagacaagcattctgaatgagtaccaaaataagctccacgagatcacgagtcttgggatgtttaagcatttggagaccatacggggcatcccggtttccttgaaagagaggcttgtggtccgcaccagcgagggcttgcaaaccgtagatgacattagggacattttgaccaaccccaagattcttagtaatatgttgcctatatccgaggacgcgctcaaggagacgcgaaagcataaactgcgaatcaccctgttctgtccggagaagtttagtgagaggattcaccggactattttctacgacaaattgaaccagtttcgagacggtctgcttagcaacagcttcgcaagcgtggacgaaatcgaattgttccaggtcaaaggcgaaaactctagcgattatgaggagatcatgaaggacgctggccttgataaaatccacgattataccctggcggtcatcatatttcccgaacattatagtaagcgcaaccttgagttgcgcatcttttacaactggctgaaaatgcggttctactcagagaacaagccactggttttccagggcgctcggattgacagcgtcttcggccggtatgcgaagtacgcatcatacaacctcatcttgcagatcccacctaaattgggcatctacccgtactcactggaggagcacgaggactatgactacatcatcggcattgattacacctattggtacgagagagatacgcctagtctgggcggtggcgccgtgttgaccagcccgtcagggctgattgagagcatataccccatcgcactcccgagccgcactgaatccctcaacatgtccaagatactgagcgaatggttcacgcgaacagtcaaaacgaaccggcatatcatagataagggccacgtgaccgtgcttatctccagggacggcatgattcctaagtacgaacgccagacaatccaggagttcctgagtgaatatagcggcgacatgggcatgaccatagaggcagtagaagttaggaaacgcatcgccgtgaggacctgggctacacaagagcccgtggcctactacagcccgataaaggttggcgactgtacctactatctggtcgacgcgcacaccggatacccgctgggggagaaagggaaccgaaccttctacagctcaccctatctcataggaagtttttacaggttcgaaaagggcaaatcctcccccgtgccaggtagcgcaaagaagcacgtgatcgaaagcctgataagacttcaaaaaatcaattacgccaccacccgcatggataacatcaagttgcccctgcccgtcgacatcacccacaaactcattaactttatccgggacaccaagatggaaatcaagggggtcggtatcccaaacagtctctttatgata

SEQ ID NO: 175 - DNA, 1833 bp, Artificial Sequence
  Description of Artificial Sequence: Synthetic polynucleotide
atgccgttcaatagcaacctgatcttcgtgaagctcgacgacctcaagagagcctttctcgagggcgtccacagtggtcacgccgtggtgtatgaggtgagcgagggactgagcaccgaggatctgaagaaaaggcttatcaaggccagcgtgatgtaccactataggtatggaaggaacgtgtttgtcttcggcgtcaaggagggcactaaggttgacgatcttgtaccaggccgacgactcggcgagcacgaggtgaaggaggttctcaagggcatcccgtctaacaacctggtgtccatgatgagcgccatgctcaattaccagctctctgtgcttctcaccagcaagggcttccagtatagctacgaagagatgcggaggggcaagtatctgtgtgtcagcaactattacggcaagctgatacggaaccccgtgaaggtttgcctcaaggtaaatgtcataaggagcctcattgacgagcaggatcagtacctgcccatcgcgcttaactacagggtgaagaagagcaggcggcttagccccgaagtaatgaatgagatccacgcggagttcatggaggccttccccagctacctcaacgacctgaaaatcataactcgcgtcttgaacgacgatatggtgaggaacagggaactgaaattcctggagatcgagtacaaaccccctgctatcattacgttccggtttcgaggcaacagcaccggcgaaaacgtgaccgacattctgaagctgggcccctacttcctgcctggggaggaggagaagatcgatgtggtctttgtgtacgaaaatgctctcgctagccaggcgaagaaactcaccaaggttttggaggataccatcaaggacgggctgggcataaagctgaacatagacgacgaacataagttcagccacgacaagccgctgggcgacgttattaagctggtgcgcgaccgattcatcaacagcgggagttgtctgctggtccttagcaaggagaaccgcctcggtcctatcttcatgagcattaaaccgctcacgctcaagaagaacttctacttcaagtctcaatttatcaccaacgaaacgattagcaaactggactcttatgcggtcaaagccaatatcgtgaatagcatcctgttcagggttgaaggtaccccgtacatgcccgttctgcggggcaatatagacgtactggcaaacaatttgttcgtgggcatcgccctgagtaagcctctgaggaagggctacaccaaaggaggcatagccctcatagacccctacagcgcccgaattatcacaagggccatcgtgttgaagcgcaagatgaggagcggcaaattcgaagcctcagacatgcacgagatcgtgtccaacatcaaaggcgtgctgaaggactacaaggagctgtacaacgtcaacgaacttgttatacatatctccaagtttctgagcgatgacgaatacggccttttttacgagtacttgcaggaccttaatgtcaacgtgcgactcctgagcatcaggaagagggacgacattacactggttagggacgggaggatggacagcctgaccatgatcaagcgcggcaagagtcatgtcgaggtcatgtattggcctcacgaaagggcctaccacccccttactatcaggatctacggcgacaatgtggacagggacgtgatgatgcgacacctgaggtttatcgagctgctccggcacatgtactacccggccagcagccgcttcatagttgagcccgcgaccattagctacagcaggagggtcgccagatttgccccctggctttcagacaatacc

SEQ ID NO: 176 - DNA, 2508 bp, Artificial Sequence
  Description of Artificial Sequence: Synthetic polynucleotide
atggaagtgtcccccttcttcaacgaactgttcaagtactacatatttctgttttttggtttcaaggtgaacatcgtgaaatcacattaccagagcattaagaagcacaagataatattctattccggtgggatcatggacgagtattacactaacgccttccccatcaacaaatactttatcaaccgcatcatctctgaaaactgcatccgctgcctgtgcaaaataaccaagctcgagaaaaaagagaagatcgaggagttgctttactctatcagcgccaccctggggggcatttacatcgacgattacaacccaatgaagaataagttcagcttctacatttggaagggaatcctgaataagaagattaaatcctacgggtctgaatggctcattaacaagatgaaaaacatgggctttaaggatccggaaaacaagacgctgttgaactatgtgaaaaaaaagtacgagaaagacataaagttcgacatcataaagaaagagaagatagaatggagtaacctcgactgggagataaaggaaaagatagtgctgggcgccataaaaactcaccctaccattcgcaaactgattgaatacaagaatgagaaattcattgacaaaattggaaagaaaattctgacttactttagcatcacaatcaccagcgacgagaacgagaattactttctgatcgtcaagcccaagcataagatcatcagctcagagacaatttacaacatgctgaagaacaacaaaatcgactttaaaactcttgagaggaagctgctgaacggcagcgccctgataaccaccagtagggcagtcggcagacggaaatacgtcaaaatcaaaaaaatcatatcccccaaggagaaggagtattggcaacatacccaggacatcaatgagcactacgaaaaggagggcgtcccgatcagcgtcggcggtgacgacatccactgctatatcttcatcggggaagacgattacgcctaccacacgaagaactccttgctctacgagggtgtgacggaggacgtgcagaaaatactcttggatatgggtaagttcctggaggagctggagacggcaaaatctatcctcaagcagggcaacctcatagacttcagtcgcgaattcctcaacattagcacgaaggacgactacacccttactctcctgagcacactgtccgatatcaaagtgaagcttaagaccgagtctggtatcatcacaggcgactaccagaaacttagggagatctttgactggatcttcgacaagagctttaaccccttgaagcctaagaattgctaccttccgctgagtattccccccatactgaatgacaagaaaaagatcggcgtgtacatcttctatagcaatattagcgaccccgagcttaggtttatcgaagggatctttaagaaactgggcctgatatgcgccatcaataagagtgtgccaaaaattgaggttaaactcaagaaggaagtggactttgaggactacgccaacagcaggatcataatcacccagaccgtactgagcaatctcgaggatggcgagcagccgttcctcatatgtataagtcccttgctgccgaataacgagttcgatgaactcaaaatgcatctgttctctcacccgcagctgatatttcaccaattcatgtatccgttcaaccttcgaaagtgccttgagaaagaatcattcaagaaacccttcatcaactcaatcctgtctcagttctttcacaaaatgggcatgtacctctttagtctgtctgacgagctggggaactacgacttcattattggttacgacataagtagggaaaaggatgacatcgggaagataaaaggtatcggcggctccgcgatcatctacaacaattacggccatgtcaagtcaatcataacgttcgacgacgtagggtctagcgagataggcaggtacgacctcctgttcgcgcaggtgcacagcgaactgataccccacctgaatctgaacaataagcggaaaattaagattctgcttctcaaagacgggcggattttcaaaaaggaactcgaaaagctcagccaaatcagcaagaagtataacttcgagatcacctacattgacgttcgcaagagcacgctgctccggttctggggtgtgcggaggggcaaagtggtgcccgagtataagaatagctacgggaagttcggacgcgcatactatattagtagccattactacaaccgctttttcaagcaaccaatcgcaatcgtggagaagtaccacatagacgagggcaattacaaacgcgtggaaatagaggagaatgatattaagcagctggttctgttgaccaagattaactacagccaactgatgccagataagatgcggctgcccgcacccgttcactacgcacacaagcacgtgaacgccgtgcgacggggctggaagatcaaggacgtctctatactgaggagcgggtgtcttcctacgatc

SEQ ID NO: 177 - DNA, 2184 bp, Artificial Sequence
  Description of Artificial Sequence: Synthetic polynucleotide
atggcctatagccttaacgctttcgaactggaaattcccgacattgacgccgacctctacaaagttgaccctcaaccctctgatgacccatatcgaatcctggggggtttggaacggtccttcgagcaacaactggacggcaaggcccagaaatggaaacaggcggaggacggagattggtatatcgccgtgataggcgcgtcagaaaggaaaactatcgagtccccctccagcggtacgagggcaggctacaccaccacgcatacgctggatccgagtagcttttgggacaggatggtgttgcaaagggcaattagcgactctgtacgatggtacatgaccaactatcaggacttttggtatcatgaggatgcggatgcactcttttatccttctcctagaggcaaagtggacgagtacgacgtctacaccggatttagtcatagggtcgagttttatgacagcccacaacttgtcgtgcgcagcgtcactaagttcatctccagtgaaagcctggcggaccggatcaaccatcagggcacagaagaagcaacggaaaaatacggtggtgagaactttaggctggacaggccggaaccaaccaaatgtactttgcacggcatctcaaccgagcgaacggtaagtgacaagacgatagattttggtgacgagatgctgtccgtgttggagtttgcacaaagaaaatatggcagcgagtgggcggacaaaatcgatcccgacgaaccattggtgcagatacgcttcgggaacagcgacccctacgacaccgctccgagcctgctgaatgcgagccctgaggagctgaatcgcaggctgaccagcgaggcagccctcagcgcacaagaaaggcagaaggccatacagaacttcatcggcaggatacactacatccaggttgaagacgagaaggtgagcgtcagcgatgacggcgtacggcccaccgagcagggcgacttcgactaccccgatcttgcgtttggcaatgacgaggtgctcagcaccggcgtcccgaacgcggtagatcctagccaggaggtgcacccgggcaactggcgatggataatcagggactacctggaggaatacggcttctgggagtcacaacgaaagctgtctgagatcgtgctggtgtacccgagaggcgaagaaagacgggcagagaacctgtaccaggacgttagggagaagctttcagagataggaggcgttcagatcaggagcgatccacatcgcgtgtgttacaccgatcaggtggagttcgacgaatgggtggctgaattcggtgactcaatcgacggtgttcttggattgattgagggagatggagacgaatactacgaaatcatagatgcatttggcggagcaccgacccagtacgtcaacactagcacctactcagagcacagaggggcgagcgacgacgtgatctttaacactgcttgcggactggccgtgaagttgggcgcatatccttttggcctggccaacgacctgaacagtgacgtgtacctcggccttagcgtggcaggggatagaagcacaacggccaccgccgttgccatagacggaagagatgggaggattctctatcaaacagaggaacccctgggccagggtagcagcacagtaagcgagggctatcccgctaagcgaatcatccagaggagcctgaagaccgcctcaagcgcctttgatcgaccaatcgagagcttcgacattcacaggaacggagactttggcgacgctgagctggaaacccttagcagtgaattgcctgcactccaggaccaggaatatgtgcataccgatgtttcatggagcgccgtcgaggtaattgaaaaccacccttacaggctctttagtgaacggggcagcagagctcccgataccggagcctatgctaagctggacgacgagcatgtactggttactacctttggagagccccagatccaccaaggtacgccaaaaccggtcctgtgcaagaggagagcaacgagccaagatcaagacatcaccgccatcggagaggacgtgttcaaactcagcttccttaactggggtagcccaatgatgaagatgaagccacctgttaccactaagattccgaaggaactcaacgagattttcgagaagtgctctagggtgagatacccccccttc

SEQ ID NO: 178 - DNA, 2517 bp, Artificial Sequence
  Description of Artificial Sequence: Synthetic polynucleotide
atgaagacgcaggatgatatcgcgcacaagcaacccattaccatcgaggtccagatcctgaaggagctcgacaagccaagcccaaaaatggccacccggttcctcgtggccgatagggacggcaacaggtttagcctggctatctggaagaacaacgcactcagcgactatgactggacgattggccagtggtacaggctggaaaacgccagaggaaatgtctttaacggcaaacagtccctcaacggtagcagcaaaatgcgcgccactccacttgaggccagcgaggaggacgaaaccagcacggatgatgtgggacgggtcgacacaatcctgggtaatatgagcccggaccaggcttacctgagcctgtttcccatcagtaggtcttttgataccctgtctgtgtacgagtacagcattgaggcagccgaggcattcgaggatgcgccggacaccgtgacctacaggtgcgctggcaggcttcggagaatcacgggtgcgggggtcgcttatgctggctcaatgaggatcgtgtcaacccgcaaactcccggacaagctcgcggacccctttagcttgagtgaacccacggagagggaactgaacgctacggacgccagggacaggcataggatagagcggcttctgaagagcctcgtgaaggccgccatcgacgatagcacctacgacccataccagatcaaccgaatcagggccaggaccccgagcattaccgctggcgacgggctgttcgaggcgtgctatgaatttgcagcaagggtcgatgtgatgccctccggcgacgccttcgtgggaattgaggtaaggtaccacacgcggagccaggtcactgcagacgtttacgaagacaaaaccgcggaactggtgggcaccatcgtggagcatgacccagagaggtacaacattagcggtacgggccgagtagtgggtttcactgaccaccacttcaccgacgccctcgacgaattgggcggtcttagtttggcggactggtacgcgcagaaggatcgcgtcccagagggggtattggaggcgctgcgagagaaaaatcctaggttggttgatattcagtaccaggaagacgaaccagccagaatccacgtcccggatttgctcagggtagcaccccgcaaggaagttgtcaaggagttggatcccgccttccacagaaggtgggatcgagaggccaagatgttgcccgacaaaaggttcaggcacgccatagagtttgtggatcatctcgggtccctgccggatatagacgccacggtggcacccgagcctttggggccgtcactgtcttacatgagcacagcagtcgacagggagaagaacctgcgcttcaaagatggaaggaccgccaccaccccgtcaagcggcatccggagcggcgtataccaacaaccgacgagcttcgacatcgcctatgtgtaccccaccgagtctgaacaggagagcaagcaattcatttctaacttcgagaacaaactgtcccagtgccagtgcgaaccaactgccgctaggcacgttccttatgaactcggcggcgagctgagttacttggctgtcatcaatgaacttgagagcgtggatgcggtgctcgctgtggtgcctccccgagacgatgaccggataacggccggagacataactgacccctatcccgaattcaagaagggcctcgggaagcagaaaatacccagtcaaatgatcgtgaccgagaacttgggcacaagatgggtgatgaacaatacagccatgggcctgatcgcaggggcaggaggcgttccgtggagggtggatgagatgccgggtgaggccgattgcttcataggactggatgtgactcgcgacccggaaaccggccaacaccttggcgctagtgccaatgtcgtttatgccgacggaaccgttttcgcctctaaaacgcagaccctgcagagtggggaaacgttcgatgagcagagcataatcgacgtgatcaaggatgtattccaggagttcgttaggcgcgaggggcgatcccctgaacacattgttatccatagggatggccggctgtttgaggacgccgacgaaatccaggccccgttcgcggatagcggagtgagcatagacattctggacatcaggaaatctggcgctccgaggattgcccaatacgaggacaacagcttcaagattgacgagaaaggccgacttttcatcagtcaagatgacacgcatggattcatcgccacaacgggaaagccggaatttgatgatagcgacaacctgggcactcccaagactttgagggtagtgaggcgggctggtgacacaccgatgctgactctgctgaagcaggtgtactggcttagcgaggcacatgttggcagtgtgagccgaagcgttcgcctgcctatcacaacttactatgcagatcgctgcgccgaacatgcgcgggaggggtacctgctccatggcgagttgatcgagggtgtgccatatctg

SEQ ID NO: 179 - DNA, 2607 bp, Artificial Sequence
  Description of Artificial Sequence: Synthetic polynucleotide
atgaagccagtgaacttggatgaaaacagcctcaacgacgtcccggtaggcgacacctatgctgtccgcttcactcttgatgcagtcttcgagaacgaagggcagtatccccggaggaatctgaaattcacagacggagggggggatgaccgaaccatcactatttggaaaaactctgcacccgaggaaatttacgaggcggactatgagcgcggtgcgacgtatcttattaccgccgtcgagtatgacatcgacgaaggtaatgacggcgagcgataccagaatctcacagtccaatcagatgctaccttgctggagatgagcggtccccctagtaccgaagaggccttggaagacggcctcgccgaaaccccagatactagcgccgattcaggtgaccacgggttgacaacctttaggactacagacgacctgccggattatgacgtctatgagtacgagctggtgccgaagcaaggattccggccgtccggagaaaatgccctccgagccacatacagggcacgacgcaaggtccgccagcagttggacgtaacacccgtcgtggtcggcgatgcgtttaagcttgtgtctctggtcaagctggcccacgagcgggtcgagcttccgcgattcaagatcaacgaggttgacgagaggcccatcgtctacgccgatgaggatgacagggatgtgttgggggaaatgctcggtgagatcctcaaggacgcgaaacgggaccagtacgacatccatggcatcgacaaaatactggagccagagcccgtcatagagaaagagggcttcaggctccacgaacggtacaacctgaccgtggaagttctccctagcagggccgcttacctgcacgtggactatcgacatcggatattgagcgacaggaccctggatcaactcgatgaagacgaaatccaccctggcctgcgcgtgaccccctcatatagggacatgggtctgtacgttataggcgttgggccggagacggtgaccgataagctgcatatcgagggcaacaagagcctggtccaataccatcgggaagagccgtgggtggacccggcgaaggtgcaagaaatcaaagacgcagatagggaagtgatctggaccgtgaggcaacggggcgatggcaccgagatggcattcccgccggagctgctcgcgcttcaagggcaccccgaaaatttggcccagttcgccagcgactttgctgaacaacaaaggctcaacacgcgcctttccgctgagcaatgcatcaccaaggctaaaaggtttgtggagcgactcgggcccttgcaattcgacggacacactgtggaattcgagaccaacccgctgttgggcgatcggaacatagccatagatggtctgtttcacccggaagcaaacgtgctgcagtttagcggaggccagaccggcacccacccctcagatgtgacacagctgggcgtgtacgaagccccggaccccttcagggtgtgccacatcaggatggagaagcgggacaaaagaatacagaggggttggagtaccttggagacgaagctggagcagattggagcgcctcccgacagtgtcgaggaggtcacgttcgacgccacaatgagccctgaccagttgggtatggagatagcggccgagataccggacgaccatgattacgacgcggccttctgcacattgccacctaaagacaccggctactttgacaccgcagaccccgagcgagtttacgatgaacttaagaaagtgttggccaccaaagaccttaactcccaattcgcgtatgaagcaacgctggacgagcgctttacaataatcaatatagcactgggtcttgtcgccgcagcgggaggtattccgttcacaatcgagagggcgttgccaggcgatagcgaactccacctgggaatcgatgtaacccaccaatacgacgagtccgcgaatggcaaccacattcacctcgctgctgcgacgacggctatccacgctgatggagctgtactgggctacacctccagccgccctcagtctggggaaaagattccccccaaggagctgaaagagatcatcaagcaagcggtgatgggctttcgcacacgctacgatcgctacccaaatcatataaccatccacagggacgggttcgcaaacgaggacctgtccgaggtagaaaagtttctgacggacctcgacgttgaatatgatgttgtcgagatcaggaagcaggccccagcgcgcgtcttgaaatacagtggtgcccacttcgacacgcctcaaaaggcgaccgccgcaatctacgaagacatcccgaaagcgattgtagcgacgtttggtgaacccgagactctcgctagccgggagtcaaccgggcttccccaaccaatcacggtggaaagggtgcacggagagacccccatcgagacacttgctgcgcaaacctacctgctgagccaagcccacataggcgccagtaacgctacagcacgcttgcccataaccaccatgtatgccgacttggctagtgcagcggcagccaggcaacaccttcccccgaccaacaagctgagggataagatcggattcatc

SEQ ID NO: 180 - DNA, 2118 bp, Artificial Sequence
  Description of Artificial Sequence: Synthetic polynucleotide
atgaagaacctgagatacaaaatcaacgcctacagaatcaaaaaagactatattcccaaggaagtttatagatacaggatccgctccttcatagagaacattaacatatataggttcgtcggtttttacggaggcgtggccctcaatcaatctgagtttatccttccgtacccggtcgaaaatctcgtcctggaatacgacggaaaagatgtaaagcttgagcatatcgacacactgaacctggaggacatcgagaataaggacaaggagaaagccgagaagctggtgaggggatacctgaccagcatatacaagttgaaacccatactctacaagatcctgcgggacgttcgagagagcaagatcattaacgatatcagagtggatcctatacccgactttacagtaaaaaggcacaataacgaatactaccttgtcatcgattttaaccacaccgcgaccgtgttgaaaaatctttgggacttcgtgggaagggacaagctgaaactcgaggattatatcggtaagaaaatcatattcaagcccaacccgaagaagaggtatactataaagagcattgaaaagcagaacaagaaggacattgatgacattgtcgagcacatcatcgagtactacaagtggacggaggaggaaattaagagcaccttcggcgaaatcgactatactcagcccatcatccattgcgagggcatcccctacccgttcgcaccgcaattttgcaatatcgtatttaccatggaagacttggatgagaataccctcaaggacctgcagagctactggaggttgcccaacgagatcaaaggcaacattatcaatcagatcgctaaaaaactgcgatttgtggagaacgagccaatcgaattggaattcattaagttcaataacaccccccttatcgtgaaggacgaaaatggcaaaccaacaaagatatacaccaccaatcgcctcttccgatggaattacgatagtaaatccaaactgtacttgccctacgacatccctgacataatcaagaacaaaacactgacaacgtttgtgctgatcgacgagaatctcaaaaacgtgagtggtaagatcaagagaaaggtctaccaaatgttcaagaattacaataagatcgccagcaagactgagctcccgaaatttgacttcgccaataaatggaaatacttctctaacaacaacatcagggacgtgatccgaaagattaaggatgagttcaacgaggagcttggcttcgcgctcattatcggcaaccgatactatgaaaacgattattacgagaccctgaagatgcaattgttcaacctgaatatcatctcccaaaacattctctgggagaattggtcaaaagacgataataacttcatgacaaacaacctgctcatacaaattatgggcaaactcggaattaagtacttcgcactggacgcaaaagtgaactatgactacatcatggggttggacagcggcctgggcgcattcaaaagcaacagagtgtccgggtgtaccgtgatctatgacagcgaagggaagatccgacggattcaaccaattgacgtgcccagccctggggaaaggatccccattcacctggtagtggagttcctggagaccaagaccgacatcaatatggaaaacaaaaacatcctgttccttcgagacggctttgtgcagaatagtgagagggaggagttgaagaaactgagcaaagagctgaatagtaacatcgaagtgatctcaatccgcaagaataacaagtataaagtctttaccagcgactacggtatcggctccatttttggcaatgatggcatattcctgccacataaaactacattcggaagcaacccggtgaagctcagcacctggctgcgctttaactccgggaatgaggaaaaattgaagataaatgagtctataatgcaacttttgtacgaccttaccaaaatgaactacagcgctctgtacggggagggtaggaaccttcgcatcccggcaccgattcactacgccgacaagtttgtgaaggcccttggaaagaactggaaaatagacgaagagttgctgaagcatggcttcctctacttcatc

SEQ ID NO: 181 - DNA, 2235 bp, Artificial Sequence
  Description of Artificial Sequence: Synthetic polynucleotide
atgagtcaagactctaggagcaccgaggtggagaggcaggccgaaatacaacctggtacctacctgttgaacggccggggggaaattcagttggatgaggttgacgcattccagtacgacctcaaggtgagtggaggcgtggagcagtattgggatcgggaacaattcaccagctctgcagcctactacctggaccaggaacacgggagccctgtcgctgagataggcaaaatgaacgtgctcagcaagacggatttgtctagatcagttagagtgtggcagagaaacgtgactcccatcaataggcagagcgttacactgaccgcagcccaacccgaggaccgagaaaagatcaaatcattcgtgcaaagctgcttcaagagggcagtgccgaccgaaaaatacagctttcgctttctcaacaagattgtcagggatgagcccgagttcaccaccggcagcgaaggcttttctgcacatccgaagcacgacgttaagatacaggtcaccgctgatggcaatgtgcttgtgcacgtggatagcgggttcagcatcaggagcaacagcaccctggacgaaatctactctgaacaggataacccttacggtaagcgcgttgcccacgaccccgagaggtatggtacccagggccaaggcacccttcgcggttggagcgactatcggtacacagaccatattagcgatgcgggtagctctgtgaacgaaatgcacaaaggggtggcggacgaagaatggcggcaacgactcgcagaggagaatccccgacttctgaaagtggagtatggcaacaaaactaggaggcaagccccccatttcctgaggctctcaccgcggatcgagcaggtgcaggatcaggatcgcgagttctatagcaggtttaacagccggagcgcgatgatgcccgacgaaagatttgaactgtctaaagagttcctgcagaacgtgagccgcttgccggtattggacatggaactcgagccgggtccggtgaacagcagttacgagttgctggaaatgcgagaggaaaacaggctggtttttggagggaagcagagggctagagacccgggcagcgggcttagagagaatggggtgtatcaaagtcccagtcagtaccggctgggggtgttgacccccgaacgatggggagagaaggcgagcgagctgatccccctgattgtgtccggcctgaacgatctgagcgcatcagcaggagttcgagcatatggatacgaattgggggacgtcagcaattacacacccgtggttcaggacctccacgaggagacggacgctgtgctcgccgtggtccccaataagggtgtggccgaggattttgggatagacgatccatacaaggagctgaaaagaaccctcctgcggaaagggatacccacccaaatgatgcaaaagtccacggtcgatgaaatcgtgggtcaaaaggcgggaatcggcaatgacaagtttctgaacgcacttagtgcagtcgtggccaaagtgggcggtaccccatggcagatcgatagcctccccgggaaaaccgacgccttcatgggcttggacgtaacttacgacgagagtagcgagcagcacgcaggcgccagtgcaagcgtagtactcgcggatgggacgactttcgcagccgagagcaccacccagcaaggtggcgagaagttcagtgcacggcatgtagaacagttcgtgagggacctcgtcttcgactttgcgggggaacagggccgagacatcgacagactgtgcataatgagagatgggaagatcagcgaggatattgacgccgtaagagagggactcagtggtattgaggcggagatcgacatagttggcatacgaaaatccgggcaacctcgcatagctgagtttgacggtactcggtttcggatcgccgaaaagggcgtgggctttgtggacgccgacagaagccagtctatcatccatgcattcggcaaacccgaaatccacgacgacaatcctgtgggcaccccacgaacctttcgactgaccaaggactctggtcccacagatgtggagaccctgacccgacaggcatactggttgtccgagatccattttggaagccccgttaggtcccctaggctccccgtgccaatagagtacgcagacatggctgctgagtatgttcgggaggagtacgtctcaccagggactgtaatagaagggccagcatacatc

SEQ ID NO: 182 - DNA, 2190 bp, Artificial Sequence
  Description of Artificial Sequence: Synthetic polynucleotide
ctccccatcgtcctgaacgccttcccacttaaagtacccgaactggagctggaagttaggcaaataccgtacgataaagagacgcttgacggcctcagggctgcgcacaaggccacccacgctttccgcaggcagggcgacaacatactgattttttccggtgatggcacatttcccgcgtctgggacgcctcaaactattgcactgaaggacaatttcggcgtgttctacagcctcgtgaaggatggtcttatccgccaccttgcggggctcgggaggaatcccagcgggttcaaccccatagagttggtgtccgcaaaacccgaagacaacctgctggtccccatactcggcgatgcgtatccttttaaggtgtgcgcgaaatacagcattgacaccagaaccgtgctggggcacccatgtctggtgatcgattgcacgaccaggagggtgttgaaggaaaatggcttgttctttttgaacgctgggttcgacctcgcgggcaggtacgtggtgacggagcaagatgacgggtacaggaaattgctcggcagcgtgagcggctgtaagggtgaaacgctgtacgtgactaggcccgatggccaagtggtgcaggccgaggctaaaaacgtgtacctggaggcatcccgcacaaatttcgacgactatattctgcacacccacagggctcagaaggacgcgatcgttgaacgaatcagacagtccgtttccgtgtttaatgggggcgaaaataagaaagcccgaatcgacacgctgaagaagtatatccagtccaaaaccattcccttgatcgacggcaccaggattgagatccaagattcccctaacatacagaaagactgcggccagatgcaaaaaccggtattcgtctttaacgacaacggcgaggcggactgggcggagaaggggctgacccaatctgggccgtacaccaagaggaccttcgacaggaatgacccctccatttgcgtgatctgcgcccaacatgacaagggacgcgttgagcagttcgtcaggaagttgcttaagggcattccaaactccaaatacttcagcaacggtctcgaggggaagtttaccctgggcactagcagggtagaagtgttcgcgaccgctactgacagcgtagacgcctacaagaacgctattgaagccgcaatacggaagaaggccgacgacggcggcaggtgggacctggccctggttcaagtgaggcagagctttaagaagttgaaagtgaccgagaacccctactaccttggcaaaagtctgttcttcctccaccaggtgcccgtccaggactttaccattgagctgttggctcagtccgactactccctcggctactctctgaataacatggcccttgcatgctacgcgaagatgggcggtgtgccctggctgcttaaatcttcacccaccctcagccatgagcttgtgataggcatcggctccgccaacatcggccaggagagaggagctgataatcagagaattatgggcatcaccactgtgttcagcggagacggcagctatatcgtgagcaatacatctaaggctgttgtccccgaagcttactgcgaggcccttaccgccgtacttggcgaaaccatcgaaaagattcagaagaggatgaactggcagaagggcgataccatcagattgatcttccacgctcaggtcaagaaattcaacaaggaggaaatcgaagcggtcagagccgtcattgagaaatatcgggaataccagatcgagtacacttttctgaagataagcgaaaaccacgggcttcacatgttcgatagtgcaaccgcaggggtgcaaaagggccgacttgcccctccgagggggaagacgttcaagctgagcaaacatgagatgctggtttatctgatagggcagagggagctgcggcaagacaccgatggtcatcccaggggcgtcatccttgatgttcacaaggacagtacattcaaagacatcacctacctttcagcccagctctactcatttgccagccacagctggcgctcttactttcccaaccctatgccagtaaccatttcatacagcgatctgatcgctcgaaaccttggttggctgaaccaactgcccgggtggaacgactccgtgatgatcggaaagatcgggcaaagccagtggttcctg

SEQ ID NO: 183 - DNA, 2115 bp, Artificial Sequence
  Description of Artificial Sequence: Synthetic polynucleotide
atgaaagagtttaacgtcattaccgagttcaagaacggcataaacagcaaatctattgagatctacatctacaaaatgatggtccgagatttcgagaagcgacacaatgaaaattacgacgtggtgaaggagctgattaaccttaacaacaactccaccatagtgttctacgagcagtacatcgcctcctttaaggagattgagaaatgggggaacgagcaatacataaatgtggagaagagggctatcaacctggagtccaacgagaagaaaattctggagaggctcctgctgaaggaaatcaaaaataacatagacaataacaagtacaaggtcgtcaaggacagcatatacatcaataagccagtgtacaacgagaagggcatcaaaattgacaggtatttcaatctggacataaacgttgagtcaaacggagacattatcatcgggtttgacatctcccataacttcgagtatatcaacactctggagtatgaaataaagaacaataatatcaagattggggaccgggtaaaggactacttctacaacctgacctatgagtacgtgggcatcgccccctttactatctccgaggaaaacgagtacatgggctgctcaatcgtcgactattatgagaacaagaaccagagctatattgtgaataaactgcctaaagacatgaaggccatcctggtaaagaataataagaactctatatttccctacatcccgagcaggcttaaaaaggtgtgcagattcgaaaaccttccccagaacgtgctgagggactttaacacgagggtgaagcagaagacaaacgaaaaaatgcagttcatggttgacgaagtgatcaacatcgtgaagaattccgagcatatcgacgtcaaaaagaaaaacatgatgtgcgataacattgggtacaagatcgaggacctgcaacagcccgacctgctcttcggtaacgccagggcccagaggtaccccctctatggtctcaaaaacttcggggtgtacgaaaacaagcggatagagatcaaatacttcatagaccccatcctcgccaagtcaaagatgaacttggagaaaatctccaaattttgtgacgagctggaacagtttagcagcaagctgggcgtggggctcaaccgggttaagctgaacaacatagttaatttcaaagaaatccgcatggacaatgaggacattttcagctacgagataagaaagatagtgagcaactataatgaaactaccatcgtaatcctgagcgaggagaacctgaataagtactacaacatcattaagaaaacattcagcggcggaaacgaggtgcccacccagtgcatcggtttcaatacgctgagctacacggaaaaaaacaaagattctatcttcctgaacattctgctgggggtttacgccaagagtggcatccagccctggatcctgaatgagaagttgaacagtgactgctttatcggcctggacgtgtctagggagaataaggtcaataaagcgggagtcatccaggtggtcgggaaagacggcagggtgctcaaaactaaggtgatcagcagcagccaaagcggagagaagatcaagttggagaccctcagggagatcgtgtttgaggcaatcaacagttacgagaatacgtaccggtgcaaacccaaacacattactttccaccgcgatggaatcaaccgcgaggaactggagaacttgaagaacaccatgaccaacctcggtgttgagttcgactacatcgaaattaccaaaggcattaacaggaggatcgccactatcagcgaaggtgaggaatggaagacgattatggggaggtgctactataaggacaacagcgcgtacgtgtgtaccaccaagccttacgagggaatcggcatggccaagcccatccgaatcaggagggtgttcggcacgctcgacatagaaaagattgtcgaagacgcctacaaactgacctttatgcacgttggcgcaattaacaaaatcaggcttcccattactacgtactacgcagacctgagctccacttacggcaatcgggatcttatccccacaaacatcgacactaactgtctgtactttata

SEQ ID NO: 184 - DNA, 3147 bp, Artificial Sequence
  Description of Artificial Sequence: Synthetic polynucleotide
atgtctgtggacgctatgatcaggagtatcggggtcgcacgggaccgcccgcttctcgttttcctcggggcaggtgcctcaatgagcagtggtatgccgtccgccactcaatgtatctgggagtggaaacgagaaatcttcttgacaaacaaccccgacgttgagaagacccagttctccgagctgagccttcccagcgtcagattgcgcatccaagcatggctggatcggcaacgacgctatcccgctcttgatcatcccgacgagtattctacctacataggtgagtgctttgcacgctctgacgaccgcagaatctacttcgagaagtgggtcaaacgctgtagtccgcaccttggataccaactgcttgccgaattggcacggcaggggcttgtggccagcgtttggactactaatttcgatgccttggcggctcgcgcagctacgtccatcaatctcactgcaatcgagattggaattgattcacagcaaagactgtaccgggcgccgggcgaggcggaactggcgtgtgtgagtctgcatggagattatcggtatgatcctttgaaaaacaccgctccagaactcataaaacaagagaaggagctcagagagtcacttgtccaagcgatgagaactcacacagtcctggtttgcggctatagtggtcgggatgagagtgtcatggcagcgttttccgatgcctatgacgcagctcattttaagggtcatcaccccctcttctggacacagtacggcgattatcccgccagtgagcccgtagctggacttcttgcttcaccgctggatcaggaacctgcgaagttccacgtgcctggggcatcattcgatgatcttatgcgcaggatagcactccacgtgagtgacggtgaagcgcgcgagcgggtgcggaagattcttgagaacttcaagacggcaccagttaaccagaagctcccctttgccttgcctagtcttcctgtgacgggtctcgtcaagtcaaacgccattccgttgataccgcctggagagcttatagaatttgatcttgtccggtggccgccgtccggtgaagtttggagcacgctccgggaaataggggatagacacggattcgtagctgccccttttcgcgggaaggtgtatgctctggctacgatagagcaactgacacaagccttcgcggacaatgtaaaggatggcgcgttcaacagggtgccgctgaataatgatgacctccgctacgaggacggaaccgccaatcagctgatgcgacgcgctactgttctggctttggctgggaaagctggatgcgcgaacgatggggatgccattgtgtgggacacgtctcgctcaaaaaccgaaagattggataggcaactttggactgtatacgatgcagtacttctgcagattcggccgctgggaactaagctcgcgctcgtacttaagcctacgctgcgggttacggattcaactggcgaggtagccccgaaagaaattgaacgggcagtcaaggtgcgcgtattgggataccagcataacaaagagttcaaccaggcgaccgacttttggaggaaaaggctcctgccctcaagagatctccttgtcagatttcctgatctggatggtggaatgactttcacgatttcaggtcggccaatattcgcccggctcaccgacgaaaggactgaaactgtcacactgaacgatgcccaagagcgatcagcatctcaagtggggttgcagcttgcagagcctaaactggtgtttgcacgcactgtaggtacgggtcccgcaacggacaccctcccggttagaggattgctgcaaaatagacctttcgatgctaatctgacagacttgggcatcgcgacgaacctgaggatcgcggttattgcgcccgctcgggacgccagaagggtacatgactatcttgggcagctgcatcagcctatagatcctacaaagtgggatgcggactatctgatgaggtttcccggcttcagctccgcttttaaatgccctttggacattccgcagccgggccaggcagcttttgtaacacttgacgagccacacgatgagagtcctcaatcagcgcggacccttgcaggccgaatcacagcggcactgtctgcattgagggcgacggagaatccctctgttacaataatatatattccggcgcgctggcacgcgctgcgagcattcgatctcgaatcagagcaattcaatcttcatgactttgttaaggccgccgcaattccagcgggctgttccacacagtttctggaggagtcaactcttgcaaatggccaacagtgcagagtgcgatggtggcttagcctcgctgtttacgtaaaggcaatgcgcaccccgtgggctttgacgggactcgatagggactctgcctttgtagggctgggcttctctgtaagacgaaagatcgatggcgaaggtcacgtcgcgttgggttgttctcatctttatagcccaaatggtcatggtttgcagttccgcttgagtaagattgataatccgataatgctgcgaaaaaatccttttatgtcctttgacgacgctagaaagttgggcgaaggcatcagggaattgttttttgacgcccacctccggctgccgaatcgcgtagttgttcataaacagaccccgtttcttaaagaggagcgggaagggctccaagcaggtctcgagggagtcgcgtgtgtggaactcttgcaaatttttgtagacgatacgttgcgatatgtggctagtcgaccaatgccgaatggagatttcgaaatccatggctatcctatccgaaggggcaccacagtagtggtcgacgaccagaccgcattgttgtgggtacacggcacatcaaccgcgctcaacccgcggcagagctattttcagggcaaacgccgcataccggccccccttgtgatgaggcggcacgcggggacgtctgatctgatgatgttggcggacgaaatattgggactgtccaaaatgaattttaacagttttgacctgtatggccaactcccggcaaccatcgaaacgagccaaagagtcgcgaggataggcgctctgctggaccgctatacggaacggtcatacgattatcgactctttatg

SEQ ID NO: 185 - DNA, 2298 bp, Artificial Sequence
  Description of Artificial Sequence: Synthetic polynucleotide
atgccacacacctccctgctgttgaactttctgcccgtctctcttagcggcgacacacgcatccatgtcggctaccggccatataacgaggatgtgctgcgggaactgagggaggagttcggcgaaagccacgtgtttaaaagggactaccaggaggacacgataagcgagataccggtcatccccggagccgagccccttagcgacaaatctactggcgtggatcttgccgaagcgcgatggctgtggaaaccacttctgaacgctgcattgcttcgcctcttcagcggaagcagagagatcacctctgattatccagtcagcgtgcttggtaaccccaagaacaacttcatcagccatgccaatctccccgactgggtgagaatcctgccccttctggaattcgagagccgaaccctgttcggtggtaaatccggtccgcagtttgggcttgtttgcaacgcccgaactaggcaccaggtcctggcaggctgcgaccatctcattgaaagaggtataagtcccattggccgctatgttcagatcgaccagccacaaagagactccagacttgcgccacgcggtctgactgttggtaaggtgagctctatcgatggggacacgttgatcctggaggatcaccgaaagggctacgagcgcgtgaaggcaagcgacgctcgccttaccggcaatcgggcggacttcgactggtgcgtgaacgcgctgttgcctggacaaggtcaagcaacgctgagcagggcgtgggacgccatgagcgccctgaatcagggacccggccgcttgcaaatgatcaatcagacagctgaatatctgaggaccgtgaaccttgaggcggttcctggggtagcatttgagatcggcgagtggctgagttctaccgatgctcagtttcctgtgaccgagaccatcgaccgccctaccctcgtgtttcatccctccggccgacccaacgacacttggaacgagagggggataaaggacaatggcccgcacgaccagaggacattcacccccaaacagttgaacatcgccgtgatttgccagggcagatttgagggacaggtagacagattcgtgggcaagctgctcgatggcatcccggactttcagttgaggaacggcaggaagccctacgacgacggtttccttagccggtttaggctggagagggccaacgtgcaaacctttcaggctaacagtgcgtcccgcgaggcttacgaagcagcgtgtgaggacgctctgaaacatgccgctgataacggctttggctgggatctggctatcgttcaaatcgaggaggatttcaaggcgctgcctgggccccaaaatccctactacgccaccaaggcaatgctcctccggaacaacgtagccgtgcagaacatcaggatcgaaacaatgagtgagcctgacaaaagcttggtctacactatgaaccaggtttctcttgcttgctacgcaaagctgggtggtagaccttggctcctcggtgcccaacagagtgtcgcgcatgagttggtgattggactgggcagtcacaccgagcaacaaagcaggtttgatcagtccgtgcgatacgtaggcatcaccaccgtattttccagcgatggaggctaccatctgagcgagcgaaccggagtagtgccctttgaagattacgccaaggagctgacagacaccctcactaggaccatagagagggtgcgaagggaagacaattggaagaacactgatagagttcgcctggtgttccatgcttttaagcagattaaggacatcgaggccgaggccatcaaacaggcagtggaatctcttgatctggagaacgttgtgttcgcattcgtccatgtggccgagcaccacccttatttgatcttcgaccaaaaccaagagggattgccccactgggaaaagaacaggagcaagcgcaaaggcgtcttgggacccagcagaggcgtgcatataaagttggcggacagcgaatcccttgtggtatttgctggtgctagcgagttgaagcaggcggcacacggtatgcctcgggcctgtctgctgaagctgcacagaaacagcaccttcagggatatgacctatctggcgagacaagccttcgatttcaccgcccacagctggagggtgatgacccctgaaccatttccgatcacaataaagtacagcgacttgatagcagagcgattggcgggtctcaaacaaatagagacctgggacgacgatgccgtgaggtttagaaatattggcaaagccccctggtttctg

SEQ ID NO: 186 - DNA, 1992 bp, Artificial Sequence
  Description of Artificial Sequence: Synthetic polynucleotide
atgtccggccttttcctgaacttttaccaggtagacatccccaccaaatccgtaccgatccacagcgtagagtatagccattacagttcaaaggaggcctttatcgcgttgaaagaaaacttcccctactttagcttctaccgggatgacgaccgaatactgatctggaagaaagacaaggatgccgagctccccgagaagaactcattgattgaaattgatttcaccgagaaagcgaaggtcctcagcaaaatactcgagagggccatcattgacttcatcgagccaaagggctacaagatattcaagaacaagtacagcaacagctgggaaatagtgagcatgaaggacatcctgaatggtgggatcgagggactcagcatcaatcgaatcgtgcatttttccccctgcttcttcttcaaggagaacaaactcatgctgggtttcagccttagcacaagcctcaaaaacgtgtttacctggaataaggcggacttcgaaaggtacggctttgacatcaagggccttaaaggagacgaagagcggatttttgccaacaagcaatcccttaagaggttcctggagaccaagggcgcagttgcaatgtatgaccaaattatcgcaaaggaaaacaagaacgcgaaaatgtttagcatcatcgacggcttctatcggtggctggagaggaacaagactgaaatccagcttccattcggactgaagataaattcagtgtctaaaaagtacctgccgttcgaggatgagctgatcaagagcgagatcatccctaagccccaaaggtatttctatagcaataggaagaacacccagagcctgcggtactatgacgagatggtgaagacttatcagccctactctctggagctctaccaaaacaaacagatcaacatcggaatcatctgccccagcgagtaccagggagagacggaggggttcataaagaagatcgaactgaagctcaaggaagtattccatttcaacagcctgatctttcacttcaagaccattacgaacaaggacctcgcgtcctataaggaggttttgtacgacgatgaactgctgaagtgcgacctgatttacgtcatcgtgaatgaggcccaggagaaactctcacctaataactccccttactacgtgtgcaaggccaagtttataggcaatggcatacctacgcaagacattcagattgagaccatccggcagaacttgaatgcgttcacaatgacgaacatctcacttaacagctacgccaaactgggaggcaccgcgtggaccatcgagaaggaagacaaacttaaggacgagctggtcattggcatcggctccaccctgtcagaaaacggccagttcgtgctcggtatcgcacaaatcttccataatgacgggcgctacatggcgggtgactgcagccccctttctaccttctccaactacgcggagaacctggaggatcacctgtacaagaccctgaagcccctggtggaggagatgagcaaaagcggcaccttccggctgattttccacttgtttaaaagtgcctctgaggagtacgagatacgcgcgatcaacggcctgcagaagaggctggcgaactacaatttcgaatttgcactcgttcacctggcctatggacacaacttccgactctactacaacgacggcaacggcgacattaatcagggcacatatatacaactgtcaaaacacagcgccctgctccacttcgttagcaagtcagacttgcccctgaaaatcgacctggacaagcggtctactttcaccagcctgttttacatcgccaagcaggtgtactggttcagccatctgagtcatcgcagctatatgcccagtaagaggaccgtgaccatcatgtatccgtcaatcatggcgaagatgaccgaggagcttaagaaggtggaaggatgggactacgagcgcctgaaagcagtaagcgataagctgtggttcatc

SEQ ID NO: 187 - DNA, 2244 bp, Artificial Sequence
  Description of Artificial Sequence: Synthetic polynucleotide
atgaaaagcaacttcttccccatccagttcaacttcgacgacttccatatccagaggcttccctaccagaaggaggtgctggacaagcttcggcaacaacacaatgcgacccatagctttttccgcagagacgattttatctatattagcccaggggtagaggccgcagcgaacctgggagacgtagtacgcctctctattaccaagcaccccgaggtcgttgcttctcttgttaggcacatattctttaggacaatcaaggataaggtccccggtctgctgccaagctttcacccattcacctttcccgccaaacaggacaaatacgatctggccctgaacatgctccccgagcgcctgcagaatgttatcacctacaagaggataaccgaggtacagcttcgattcaacgagaccgaagagcaaccccagttcgtcgccgtagttaaccacaggtaccagtggactatcgaccgaacttgcgagcaattggtaaacgagggtctggacatccttggcctggaggtgaactctagtacgagccctgattattcagacggagttgtggcaccagagctgacactgttgggcagggtgatggccgtgaacggggatcacgccacagtagggaccaaccagggtccgacagagtatgccctgttcgaattgaccttgttcaagtccaaggagaacatagtgaactaccttggatctttggtgggcgagggtaaagccgaacaaatagtcaaccatatcaaacaagatgaaagcagaaggctgcaaccggacgttgtgatgagggagatcgaggaaatgggagtgtggctgtctaggctggcctacagaaactttgactccttttgcttcaccatcggaacgaacaacgctgtcagcggccaagcaggtatcagactggaggagccaaagctgatatttgacgtctcaggtacgaacatacacgctacccccacaaccgggctcaacaccttcggcccctatagtagaagcacgagtttcgacgttaactctccgaagattctggttgtgtttcaccagcggaacgcaggccacttcgcagagtttctcgcacagctgaagggcggcatcgctcagcacgcatactttgctaacgggatggtcaggaagtatggtctcacggcaatggagtaccggattgccgagatcactgactacaccgtgccccaatatcttaccgccatcaataagctgcttagggcggagaacggaagctttgacatcgccatcgtggagacctgtgaggatttccggaggctgcctcccatggataatccgtattttcaggttaagagtttgttgtacagccatggaatcagcacccaattcatcagagcggaaaccgctcagaaaccgatttattcaatagatagcatcgcgctccaaatgtacgccaaattgggcggaacaccatggacggtgccaatagggccgagcgtagatcacgaattggtgataggcatcggtagctccatattgcgcagcaaccagtatgcaggtgcaacccaagctcgaatagtggggatttctaccttcttcagcgccgacgggaagtacataagcaatagaaagacccaggacgtgccttacgatcagtacttcgatgagctcttgcataaccttaaagtctccatcgacgagatttccaataactacagctggagctcaggcgaccgcatcaggatcatattccacatcttcaagcccataaaacacatcgaggcagacgtcgtcgcaagcctgatggaacagtaccaggagttcgatataaagttcgcttttgtgacctttagcgagttccacccgtatgtgctgtttaatgaaaatgaaaggggggaatttgatgcgtataggaaggtttacaagggcacccatgtaccgtggcgcggttacaatgttctgctggatcctcggtcatgcctggtccagatgctgggaccccatgagatgaagaccagccggcacggcgcttctaggcccgtccttgtgagaatccaccgcagttctacgtttgtagacctcgcgtacgtcgtgcaacaggcctttaagtttactaggctctcattccgcacgttctaccctgtgcatagccctgtgacgctgctctacagtaatatgttggcccgacagctcaaggacctgaggggcattccgggttggaactacgatgtagctagcaggcagttgaggcacaagaaatggttcctg

SEQ ID NO: 188 - DNA, 2544 bp, Artificial Sequence
  Description of Artificial Sequence: Synthetic polynucleotide
atgcaaggcactatatccataaacgaggtgaggatccagcttaatactattaagaatctttcagtgttcaagtgcagcctcagcggaattagcacccgccataagaaccagatcgagttcatccttcgcagcgagcaaaaccgagttagcatctttgagggtgaagtgatctttgcgcttcccgtcgaacagcagaacctcgaaagagataagcaggctctgttcagcttcctggtcaaacaacaaagggatctcaatctgaaacagctgagcctggtgcccctgagggaggtgcccgagcgcgttatcgagcgactgactttcgcaatggttagctatcaggccatgaagcagggcatcttctctatctatggtcatacattttttcgccccacccttatgacggataggcttgcgcacaaggcggtggaagtcacgacgtgcatcgaggatggcttcctcaagttttatctggacccgacgtacattgcactgacatgcataacggacacagcacgcgaaaatagggagaacctggaactggtcgggctctgctctttccgcaacaaaaacctttgtagccttgtcaggccggacggctcatgcaactgcctcatacctggtaagttggggtattacgtccaggagatggggattaaggacgttgaggatgatagcaaggactttctggccaaacggttcaatagctgtccccggtttagtgagcacacgcgctttatacaagtgaaggcgagtaaaagaggcacgaagtactccctgttcccttcttacgtagtttttagcaggttgtcccgaatggacctgtccgctaagccagatgtgcggtccagttatcggaaggccacattgatggactctcacgaaaggcttaacttgaccaacgactggataagacaaattttcatgatcgggcagaagggccttcaaaattggggtgttataaaggtcaaccagaccgagattcccgttgaaattgtactcacaattgcccacgccatcgcgcccaagacttctcaaggcatctataaggctatattcctcccggaccagcaaattacgaatgacagcaataacccaacgcctcaaacgctgagcgggggttggctcttcacgaataggggtgcgttcgacaggagggatcctaataggccttttaaagtaatcagcccctacatcatcgtgcccaacaatgagcaaagcatcagctcttgccgccagctgatcaactacttcagcaacggcaggtacaaggcccggtgcaagggtgacagagactttattggtatttcattgcccgaaaacaagggcaagtacaacacatcatttgtcaatgctttcgaagaggaggacggcctgtatttcgttgaagagacgatacagggctaccagaaggcgctgcaagacattgttagagactggaatatcacgtccaagcgggacatcaataaacacgctatagtgatcataccgggcgagaacgatattgacgacaatcctttctattatcaactgaaaaaggcgttcgtagaggaagggattcccagcaccttcatcacgtacgagactatgaacaaaatcaacgaccccgacatcgcgttcgggccaatcatggacagcctgtggttgaacatttacagcaaaatggggggcaaaccgtggcgcctcgctaatagcctcggcaacgtgcactgctttatcggtattgggtttggaattaaccccgagaccaccggaaaccacatattcgcagggatcgcccacatcttcgacaactacgggagttggatagacgtagcgagtgattccgccaacctctcccaaaacgatctgaactcattcgagggcacggaaaagtacacacaggggagtgctagctttaagatcagtcagagcgtgtcccagtccattgtgtataacgcattgaagctgtaccaacagaagcaaactaagacccacgaaaacgccacaaacatcgtcctgcacaaactgggccagatctacgagtgtgaggtcatcgggttcctcgaaggaattcgccaagtgctcgggagtctgggcgactgcaagctgggattgctgcaaattgagcaggagcaccacctgcgcctctatggcgcagcagcccaaaccggcaaggagaacaacacgatctttcgcggttcagcacttcaactcaacccggagaagctggttatcgcgtccactggccgctcttaccggcagacgagctccgggctgtttatgaattatccgggcatcggcaccccccagccgctcctgttgacttctatcgtaccgaatcagcagatcctgcagaagtacggctgtaacgcaaaccaattctactcaagcgaggacctggcgaaacatgcaatggccctgacgcaacttcactgggggtcactgaaggataatgtaagattgccgattaccacgctttacgcgcaaaaggtcgccgacttgattagcaagaccaacatgcggatcaatccaggcttgggctacttccgaccctggtttctt

SEQ ID NO: 189 - DNA, 2088 bp, Artificial Sequence
  Description of Artificial Sequence: Synthetic polynucleotide
gttccagtgtaccttaatcggttcctgctggaccacctcacatcacccttgtccttgccggcgtttcgggtcgaactggaccctcccccttccaaagatgaagtgcacccgctcctggctctcgtcggtcgggaagcgggagggctcgtgaggttccagaacaggctgatcggctgggaggctccacgggccctcgaaggtcaggttaggcgaggcaagcagtcatatagactggtgccccttggccggcaggcactcaatcttagaaaacccgaagaaaggcaggcgctcgagaatttgtataggatccgactggaaaacatcttgaaagccctcgccaaacgacatagggctagagtcgaacgcaggggcaacggcctttttctgtggaggccagagaatccccgagaggagaaggaggggtggcacctttaccggggaagcctgtaccgcatacatctctatcctgacggcgaagtgatacttgaagtcgacgtgcagcatcgatttcaacccactctccatctcgaggagtggctgcaacgaggctatccactccctaggcgcgtgactaacgcctacgaggacgagaaagaatgggcactcctgggcatcgaagaggggaaggatccccgctcttttctcttggatgggggcgagtcattgcttgactaccatcgcaagaagggacgattggcagaggggcaggaccccggtcgagtggtctgggttgctagaggtaaagaacgcgagcggatcccacatctgagcgtcttgttgaagccagtcatcaccatggagctgctggcggaagtcgctgaggtcacgcaggaggccttgcctgcgcttcagctcgaacccgaggaacggctgaaggacattaggcgcttcgctgaacctgtactgcaagcgttcggcaaacgcgaaactgcaaaaccccttgaaggcagagcccagcgattgccgcgacccagtttgttggcacggggaaaaaagcgagtgggcaaagtagcggacgtactcgaaaagggagcattgtcaccgggcgagacacggttggccctgctcgcatgggagggagacgggaaggccaaaggcggtctcgcgtacttggaggagaggcttcagggcgtcgggtctgcatccggcatcaaacttgaacttaaacggcgatttctgccccgaggcgataacctcgaaatggcacaggtgtttgaggagctctcccaggaaggagtaggtgccggtctgcttctgactccgcgcctcacagaaggggaaagacgcgaactgaaaaatactgcggcgagccatgggctcgctctccaactccttaacccgtttgaccctggcgacatctacagggtgaataacgctctgcttggatttctcgcgaaggccgggtggctgttcctgagactggagggaacttatccggccgacctggtggtggcctatgacgcaggcggggagagtctccgattcggcggagcctgcttcgcccacctgactgatggcacgcatctggggttcagtctgccagccgctcagggtggtgaacggatggccgaggaggtcgcgtgggagttgctgcgacccctgctgttgagataccggaaagcgaagggccagacaccagggaggatctttctgctccgcgacggtaagattcaaaaggaagagttccgaaaagtggaagaggaactgagaaagcgcaatattccctacgcgctgtttagcgtccggaagacgggggctccccgactgttcagcaaaaatgggccgctcggtgacggtctttttttgcgactgccagaggaggagggcgggtttctgttgcttagcgccgagggtgggaagggcaccccacggccggttaagtatgtgttggaggcgggagaagtggacctcaacctggaggaagctgccaggcaattgtatcacctgagtcgcatctacccgggctccggttaccgattccccaggctgcccgcaccgttgcatatggttgataggatggtgagggaggttgcacggctcggcggcagccataacttgagactcaaagaagaacaactgtttttcctg

SEQ ID NO: 190 - DNA, 2235 bp, Artificial Sequence
  Description of Artificial Sequence: Synthetic polynucleotide
atgaataacctgacactggaggcctttcggggcattggcaccatcaagccactgttgttctatcggtacaagctgatcggcaaagggaaaatagagaatacctataagacgatacgcaacgcacagaatcggatgtctttcaacaataagtttaaggccaccttcagtaaggatgaaatcatatacaccctggagaagttcgagattatcccgacgctggatgatgtgacgatcatcttcgacggggaagaagtgcttcctataaaggacaacaacaagatttacagcgaggtaatagaattttacattaacaacaatctccggaacgttaagttcaactataagtacccgaagtacagggctgccaatacaagggagatcacgggcaacgtgatcctcgacaaagatatgaacgaaaagtacaagaagagcaacaaaggcttcgaactcaaacggaagttcataatcagccccaaggtcgacgatgagggtaaggtcacattgttcctggacctgaacgcgtcatttgactacgacaagaacatctaccagatgataaaggccggaatagatgtggtaggagaggaggtcatcaacatctggagcaataagaagcagcgcggtaagatcaaggaaatcagcgacattaagataaacgaaccctgcaacttcggccagagcctgatagattactatataagcagcaatcaggcgtcacgggtgaatggatttacggaggaagagaagaacacaaacgtcatcatcgtggaaagcggcaaaagccgcctgtcatacataccgcacgcgctcaagcctatcataacgcgagagtacatcgccaagaacgacgaagtctttagcaaggagatagaagggctcatcaaaatcaatatgaattacaggtacgagattctcaagaggttcgtctccgacatcggcactattaaagaactgaacaacctgcgcttcgagaaaatctatatggacaatatagaaagcctgggttacgagcagggtcaactcaaggaccccgtgctcatcggcggcaagggtatacttaaagacaaaatacatgtcttcaagagcggcttctacaaatcccccaatgacgaaattaagtttggcgtgatatacccgagaggctacataaaagatacccagagcgttatccgagccatctacgacttttgcaccgagggcaagtaccagggaaaggataacatattcatcaataacaagctcatgaacatcaagttctccaataaggagtgcgtctttgaagagtacgagctcaatgacataaccgagtataagcgggctgcaaataagctcaaaaagaatgagaacataaagttcgtgatcgcaatcatccccactatcaatgaaagtgacattgagaacccctacaaccccttcaaaagggtctgtgccgagatcaacctccccagccaaatgatcagtctcaaaactgcaaagcggttcagcaccagcaggggccaatctgagttgtatttcctgcataacatcagcctcggcattttgggcaaaataggcggcgtaccctgggtaattaaggacatgccaggcgaggtcgattgttttgtgggcctggacgtgggcacaaaagagaaaggaatccactaccccgcatgcagcgtgctgttcgacaagtatggcaaactcattaactactacaagccgacgatcccgcagagtggagagatcattaaaacagacgtgctgcaggagatctttgacaaggttctgctgagctacgaggaggagaacggccagtatccccgcaacatcgtgatacacagggacggcttcagccgggaggacctggagtggtataagaactacttcctgaaaaaaaacatcgaattcagcatagtagaggtccgcaagaactttgccacgcgacttgtaaacaacttcaacgatgaagtgtccaacccaagcaaaggttcattcattttgagggacaacgaagcgattgtcgtcacgacggatattaacgacaacatgggagcgcccaaaccgatcaaagttgagaaaacgtatggcgatattgacatgctcacaattatcaaccaaatttacgcactgacacagattcacgtggggtccgcgaaatcccttagactgcctataaccacgggctacgccgataagatctgcaaggctatcgattacatcccgagcggccaagtcgataacaggctgttctttctg

SEQ ID NO: 191 - DNA, 2241 bp, Artificial Sequence
  Description of Artificial Sequence: Synthetic polynucleotide
atgaactataccgctgctaacacagcgaacttcccgatatttctgagcgaaataagctttctcacaaccaataacatttgcttgaactgtttcaagcttaactaccaggtaacgaggaagatcggtaaccgattttcatggcagttcagcaggaaattccccgacgttgtagtgatattcgaagacaactgcttctgggtcctggcaaaggacgagaagttcttcccctcaccacaacagtggaaggaagcacttagcgatatccaggaggttcttagagaggacatcggggaccactactacagcatctattggcttaaagactttcaaataaaggccctggtgaccgcccaactggcggtgaggatactcaagattttcggcaaatttagctacccaatcgtctttcccaaggatagccagatatcagaaaatcaagtgcaggtcaggcgcgaagttgacttttgggccgagatcatcaatgacaccaaccccgcaatctgtctgaccgtggatagtagcattgtgtacagtggcgaccttgaacagttttacgaaaaccacccctacaggcaagacgccgctaagctgctggtgggactgaaggtgaagaccatcgaaaccaatggcaccgcgaagatcatacggatcgccggtaccataggcgagcgcagagaagacttgctgaagaaggccacaggctcaatgtcacgacggaaactggaggaagcccatctcgaacaacccgtcgtcgcagtccagttcggaaagaacccccaggagtacatatacccgcttgcggcccttaaacctagcgtgaccgacgaagatgagagcctcttccaggtcaaccacggagacttgttgaaggagaccaagatcctgtatgcggagaggcaggagcttctgaagctgtacaagcaggaggcccagaaaaccctgaacaactttgggttccagttgagggagaggtccatcaattctcaggaatatcctgaggtgttttggactcccagcatcagcctggagcaaaccccaatcttgtttggcaagggggagcgaggtgaaaaaagagagattttgaagggcctgagcaaaggcggagtgtacaaaaggcacagggaatacgtggacacagctcgcaaaattcgcctggccatacttaagcccgctaacctccgcgtgggcgactttcgggagcaacttgagaagcgattgaagctttataagtttgagacaattctgccaccggagaaccaaattaacttcagtgtcgaaggcgaaggttccgaaaagagggcccgattggaagaagcggtcgacagactcataaggggggagatccccgtagacattgcactggtgttcctcccgcagagcgataggaatgcagacaacaccgaggagggaagcctttacagttggatcaagagaaaattcctcgataggggcgtgattacacagatgatttatgagaaaacgcttaacaataagtcacagtacaacaacatcctgaaccaggtggtgccggggattcttgcgaagctgggaaacctgccatacgttcttgcagagccgcttgagatagccgactacttcataggcctggatgtggggcggatgccaaagaagaatcttccggggagcctcaacgtgtgcgcgtctgtcaggctctatggcaagcaaggcgagttcgtgcgctgccgcgtcgaggacagcttgaccgagggcgaagagattccccagcggatcctggaaaattgcctgccccaagcagaacttaaaaaccaaactgtccttatctacagagatggtaaattccagggaaaggaggtggataaccttttggctagggctcgcgcaatcaatgccaagttcatactggttgagtgctacaagaccggtatcccccgactgtataacttcgagcaaaaacagatcaacgcaccctccaaggggctggcactcgcgttgagcaaccgagaggtgatcttgattacgagccaagtgagcgagaagataggcgttcctcggccacttagactcaaagtgaatgagctgggtgaacaggtgaacctgaagcagctggtcgataccactcttaaactcacgctgctccactatgggtctctgaaagacccacggctgcctattcccctgtacggtgccgacatcatagcctatcggcggctgcaaggaatctacccatcccttctcgaggatgattgtcagttctggctg

SEQ ID NO: 192 - DNA, 2460 bp, Artificial Sequence
  Description of Artificial Sequence: Synthetic polynucleotide
atcaccagctacccttacgctaggaacaaggccgacatgattcgcaaggttaattggaatctgatcgtgttcgacgaagcccacaggatgaggaatgtctataagaagtccaataagatcgcccgaaccctgcgcgaggccactgccggctatcccaagatcctgctcactgcaacccccctccaaaactccctcatggagctctacggattgatatcttttattgacccccacatcttcggggatgagacaactttccgcagacagtttagtcgcggcaccaaggaaatgagcgagatggactttatcgacctgaaacaacgaattaaacccgtgtgtcaccgcaccctgaggcgccaagtcacagagtacgttaactacactcagcgcattccgatcacccaggagttcatgcccaccaacgaagaatgggagctgtacgagaaggtcagcgcctatttgcaacgagaacatctcttcgcgctccccgcgtcacaacgagcacttatgaccttggtagtgcgcaaactgctcgccagctcttcatttgctattagcgataccctgctgagcctcatcaagaggttggaacaactgctggaacagctggactccggcaagacggagattaccgtagaacacagcgatgtctacgcggacgtggacgagtttgatgatacagtggaggagtgggaggaggacgaccagccttcttacatagataaactgagcccagacgagatgaaacggttgattcaggaggaaaaggaagaactggagcagtactacagccttgcaaaaagcattaaagagaactcaaaggctgaggccctcctcatagcgcttgaaaaagggtttgaaaagctcaggatgctgggggctaatgagaaggccgtgatcttcacagaatcccgacgcacacagatgtatctgagagaattcctggagagaaacggctacgccgggaagatagtgctgttcaacggtgaaaaccaagacgaacaagcgaagcagatctatgagcagtggttggagaagcaccgacacgacgacaagattacgggctctaagacggcggacatgcgagccgcgctcgtggagtactttaaggagcaggctagtataatgatagcgaccgagagcgccagcgaaggcatcaatctgcaattttgcagcttggttgtgaactatgacttgccatggaatccgcaaaggatagagcaacggatcgggaggtgtcatcgctatggtcaaaagcacgacgtggtggtaataaactttctcaattgtaaaaacgaagcggacaagaaagtagatgagatattgtccgagaagtttcggctgtttgagggcgtatttggcagcagtgatgaagtcctggggtccctcgaaagcggcgtggatttcgagaagagaatccaacaaatctaccagacctgccgaaccgcggaagaaattgagcaagcgttcaagaacctgcaagctgagctcgacgagcaaattcaactgaagatgaaggagacccgaatgcatcttttggaaaacttcgatgacgaggtgagggaaaagttgcgagaccattatcaccaaacctccctgcatctgaataggatggaaaggtatttgtggaacctcagcaagtacgagggggcacgcgaagccatctttgacgacgagacgctgtccttcgtgaaggactacgagacctatcagatgatcagccaggcgaagaaacaaaacagtccaaacgtgcatcactttcgattctcccacccgcttgcgcagaagtggatcgaacaggccaagagcagggaattgttgccaaaggagataacgttcaggtacagcgactacaagggcaaagtctccatcttggaaagactcatcggcaaggagggttggttgagtctggacctgcttcacgtccagagccttgagagcgaacaacacctcatctttagcgccatcgacaccgagggcggtcaactggaccaggagatgtgcgagaaaatgttcgagctgcccgctgtggagggcgaggaagtagagatatccgactccatccgaaacacattgagacgaatctcagagggccagcaagaggcaatactgaatgagattatggaacgggcgtccgcctacctcgactcagaactcgagaaactggaaaaatggtcacaggacctcaagaataagctggagaaagacattgatgaaatgacggtggagatcgagcatcttaaacgggaagctaaattgacacgcaacctggcagaaaaactcgaaaaaaacaaacagatcaaggagcttgagaagaagcgcaacgaaatgcgccggaatctctatgaccaacaggacgaaatcgatgaacaaaaggaccgcctcttcgaggaggtagagaaaaaacttgaacaacggactgcgacggagcacctcttcactatcaaatggcggatcgtg

SEQ ID NO: 193 - DNA, 2130 bp, Artificial Sequence
  Description of Artificial Sequence: Synthetic polynucleotide
gtgaaccattactatttttccgaatgcaaggcggacgagaaagccagcgacatagccatccacctttacaccgtgcccctgtccaacccccatgagaaatacagctatgcgcacagcatcgcctatgaattgagaaaactcaactcatacataaccgtggccgcgcacggtcagtacatcgcgtctttcgaggagatatgccactggggcgaccacaggtacatacagcacgaacatagaccaatccagtgcagcctcccgatggagaggaccatactggaaagactcctcaagaaagagctcgagaataggtgcaaaagcagctataagatggacaacgaccttttccggttggctaacgagcaaagcatgcacgtgggcgagatcagcatacacccagcgatctacatctcattcagcgtggaggaaaatggtgacatatttgttggcttcgactaccagcaccggttcgagtaccgcaaaacactccaagacgtcatcaacaacgatccctccctgcttaaggaaggcatggaagtggtggaccccttcaatagaagggcctactattacacttttgtgggcatggccgattataccgccggacagaaaagccccttcctgcagcagtctgtgatcgactattatctcgaaaagaatgagctgtggaagctcaagggtgtgcacgaaaaaacccccgtggtgcacgtcaagagccgagacggtcacttgctcccgtatctgccgcacctgctcaaattgacatgttcatacgaacagctcttgcccagcatgaccaaggaagtcaatcgcctgattaagctgagccccaacgagaagatgagtaagttgtatacggagatgtttcgattgctccggcagcaacaggtgctgaccttcaagaaggaaaacgtgcgagccgtcaacctcggctacgatgtgaatgaacttgacagcccgatcatggagttcggacaaggctacaagacaaacgagatctatcgaggcctgaagcagagcggagtatacgagcccagctcagtggccgtgagcttttttgttgaccccgagcttaactacgacccccagaagcggaaagaagtaggttgcttcgtcaaaaaactggagagcatgagcgaggccctgggagtaaaactgaacataagcgaccagccccgacaactttatggccagctccccaaggactttttcaagcaggacaacctctcatatcatttgaaatctatcaccgaccagttcaggggaacggtggtggttgttatcggcactgaagagaacatcgaccgggcatacgttacaatcaaaaaggaattcggcggcaaggaggatctgatgacccagtttgtcggcttcacctcctccctcgtcacggagaacaacatttttcactactacaacatcctgctcggcatctatgcgaaagctggtgttcagccctggatactcgccagcccaatgcactcagactgtttcattggactcgacgtaagccacgagcacggtaagcacgcatcagggataatacaagtgattggacgggacggcaagattatcaaacaaaagagcgttgcgacagcagaggccggagagactattgccaatagcacgatggaagaaatcgtcaacgaaagcatttattcctacgagcagatctacggggccaaaccgcgccacataacattccatagagacgggatctgtcgcgaggacctcgattttctgcaagcgtatttgcggagtttccaaatcccattcgacttcgtagaaatcataaagaagccgcgacgcagaatggcgatatactctaataagaagtgggtcacgaaacagggaatatactacagtaagggcaacaccgcttatctgtgtgccacggaccccagagaatccgtgggtatggcgcaacttgtcaagatcgtacagaagactaacggattgagcgttcacgagatagtgagcgacgtgtataagctgtccttcatgcacatacacagtatgctcaagaccaggttgcctatcacgatacactatagcgacctcagctcaacgttccacaaccggggcttgatccatccccggtcccaacatgagagagcactcccgttcgtg

SEQ ID NO: 194 - DNA, 1710 bp, Artificial Sequence
  Description of Artificial Sequence: Synthetic polynucleotide
atgaatttccagctgtgcgaccaacgcaaagccattatcgccgaaccaggccatctgttggtcctcggtgggccaggaagcgggaaaactaccgtcgccctcttcaaggccaagcagagatttagcactctgaaacctagccaagaaatcctgttcctgtcattcagtagagctgccatcaggcaggtcctgctgcggtgcaaggagattctgaagcccgcagagagacgcgctgtcgccgttcaaacctatcatagcttctgcatggacatgctgagggcgcacggtagactgctcctgggccaccccgtgcgattcatgtatcccggcgacgagaggcttcaaaaggccgcattcgagggggactgggaggcggaaagacaaaggcaagccaaagagatgggcatcttttgcttcgaccttttcgcgcaaggcgcagctgagttgctcgagaggtgtgccgcacttaggaagcttataggggacagcttccccatgataatagtggacgagttccaagacaccgacgacaaccaatggcggatcgtggcgcaacttgccaaggtagcggacatcttctgccttgccgaccccgaccagaggatctttgactaccgagacgacatcgacccccttcggatcgagggtttgcggaccactcttgcccccagggagttcgatcttggcggtgagaatcaccgctccccgaacgcagggatattgaacttcgccaacgctgtgctgcataaccagagccccctgcccgataccagcgacatcatgcaactgcggtactggcctagagcgttcgcgagcaccgtgcatgcctgcgtagtgtttaccttcagcgaactcaggaaactgggcgtggagaaccccagcgtggcagtgctgagccgatccaacgggcttatcagcgatgtgagcgccatactggctgagaagcacgcgtacaacgggagggaactgccaatcgtggaacacgacgtggtttgggacgcggagctgtctgcggcagcagccgtcgtcgttgcgtccaccctggagtggccaacagccgctgcagaggttgctgttgccaggacacttgcgctcatagcagcctattacaagctgaagaacgccgaggaacccaccaagagcgcggctgaggctgcccaaaagtacgaggcggctgcaagcaaggtggccagtgaggagaccccaaggatcaaagccgcgaaagaattgctggccgctcaccaaagtggcatccagatggtgggcgacccggtggccgattggaagtctgcgaggagggtattgcaagagataagcgccctgggtgagttgtacagggaggtccggctcgtgaggttgttccgggcaaccgacgccttggcttccggcctgagcaataggtggttggctactggaagctacgagggcgtgtccgacctggtgaagggcatccttgagcaggagaaactgattgccgtggaaagggacccaagaggctgtatactgatgaacatccataaaagcaaaggtaaggaattcgacggcgtggtactcattgagggggcatttaagtcccatttcttcgatgagcggaaggaagtcagcccctatgagaggtccagacggctcctgagagtcggtctgacccgcgctaggcatagggtgacaatccttagacctcagggagcgaggccccttgtggatcccatc

SEQ ID NO: 195 - DNA, 2283 bp, Artificial Sequence
  Description of Artificial Sequence: Synthetic polynucleotide
gttccaggcggtaggggaccgctgctcgtgcttaacttccttcccgctcgcttcgacggccgagttgatgcgggcaccctccccttcgagacccctgataaattgagggccattagggaggaactgagaacttcccatgtagttgtaacgcgaggaaaagaggtcgtatgcgtgcccttcgttagtggcgcgaaattgatcggcaaacgaaccactatcaccgcagcgggacccgacctcgtcgtacaaacgagtcttctcgaatccagcctgaggcggaccttgaccgaaaaatggaagtacgaattgcgcagggaaaacccgctcacctttgtgtcaaggacgccaggaagggacctgctggagaaggcccttggtcgggagttgccgggactccatgtgttccccgcttacagcctggacgtgcgcagatacggtcctggggggttcagcggggttgttgtaggattgaagacccgctatgagatcgacctgcctgtcggagtgctgctcaggaggggcgttcaagtaaacggcctttatgtcctggctgaaagccccctcgcgcctacgtggcccttccaagatccccacaccagaaggcggctcgtgggacaagttgtcgcggtggatggcgacaaattgcgagtgaggtgtagggacggggagctggaacttgatgccgccgaagcatggattgagcccaacactgccaacttctacgccgtcctgcggaaggcgtgcggacgctcttacgaacgagactttcacgccctggaagcccaagtcgtgtccctgactaacgcccagcagcgaatcgccgataccaacaggatcgccgccaacctgataggccttggtaaattcgacatcagtaacggcttgactgccgagctggggaaaccactcagactgacttccactcaacatccacacgttcggactctggccgagcccacatttgtgtttgaccagagcggagacaaaaccgcgccttttcccgagaccgggctgaccaagtggggcccattggacgctgagagctttacacccaaggcaccacacatcgccgtggtggttccgcggcagtttcagggtcgcgtcgaaacgctggttgagcggttcaggaacggcgtgaggggcagcaacgcctatgccgagggctttgtccgaaagtttaggctcaccgactgtaccttcagcttcaccgtttttgacggtgacgctactgacgcagccgcatataggcaagcgtgccttaccgccctgagtaatgacgagcaaattaacctcgccttcgtcttcacatcagccgtgcaggagcatcaaacgggggacgacagtccctatcttgtcagcaaatccaccttcatgagccagggtatccccgtgcaagagtatcaagtggagaacatcatcggggattcaaacttggcttatcccctgtccacgatggcgctggcgtgctacgccaaactgggtggcaccccttacgccataagcgatcgaggacgacctatggcacgagaactgatcttcggcatcgggtctgcccaggtaagcgacggaaggatgggcgaaacagagcgatttgtgggcattaccaccgtgttcaattacgacggtaggtacttggttagcaacgttagccgcgagacaccctacgaaaggtacccgcaagccctgcttgacgcattgcggacttgcattgccgacgtgaaggttaggcagggatggaggtccgacgactttgtgcggcttgtcttccatatcttcaaacctctgaaggacaaggaagcacgcgccgtaaaagagctggtgacggagctgacgtctgaatatgccagcgtggagttcgcttttgtgacagtggtggacgatcacccgtggctggtgctcgatgaaaacagcgatggggttaaggttgggcgagggactaagggcaagcacgtagctcggaggggttttgccctgccgatttccaaaagggagcttcttgtgacggttaaaggtccccgggaaatgaaatccgataagcaaggggctcccaagcccctcttgctcaagctccatcgcgaaagcacctttacagacatcgactacctggcttcccaggtctttcaattcaccgccatgagctggcgcaggccataccctaccagcaaacccgtgactataagctacagtgacctgattgcgggacttctcggaaagctgcgacacgtgacgaactggaatagcgacatgatctacatgaagttgcgcttcagcagatggttcctg

SEQ ID NO: 196 - DNA, 2052 bp, Artificial Sequence
  Description of Artificial Sequence: Synthetic polynucleotide
atgcagcaggagatccagcttaacatcatccccttcaccgcccctgtggaagaggcagagttcgctttttacaccgccaagcaagacggctactgccccatccataaggatgacctgaacggggccatcgaaggcctcgtggatgaatcagacctgcactacggcaactggctgtacactgacttcgctcccgccaaagagaacgccatcataattagcgtcaatctcaatgactgtaagtacttcgcccagcactactacaggcaccttatcaggacccacttcaagggagtggccgacatcatgaggaagaatttcaccaacgaaatcgaggtctggttccacaataccaaagccagctctaccaagtttaaggtctataaccagtttaccctcaaggtacagcacaacagggtgacggacggaccggaacttgtcgtgtccttcgacgggacgacgaaggtgctgaacaagtctatcgccgagatacacaacttcaaaacggagctttacaactggataaactgcaacggcgagcttaatcgctggaaatacctgaccgacgatcagaagctgaatcacgaaaagaactacccggtagtgtcaaacacacttaaaccgcatttcgacattgcctttgacgttcccgattttaagaaccggtatcccaaatacttcactcttctgaatgacttctacaacaactatctgaatacagacgcctttactgcgatcttgccgctttccgctgacggattcttcaagccaaatggcctgtcagtgcagaggatcaacggcactagcaatgagctgcaattcggcaatggcgtcggcgtggagcccaaaagggatctcaagcgcctgaagccgtataaacccgtgcccaaacccagcaacgtaaagtttttcttcatctatcacaagccagatagggagcatgcggtcaaaaacatctggcagtatttcaaagacggatacaacggccaataccccttccccaagatggaggaatacatatctcagcccttcgagcttgaggagaatggatctatctcattcgacaatatcgacgacgcggtaagcgttgtccaaaaagccatcaagaacaaggatcggctgcccgacactaaatactttgcggtatacatctcccccgtaccaaaatgggagaaggaccctaaacggaatagtatctaccatcggatgaaagagatactcctgtacgaggggatcaccagccaggtgatctggaaggagaacattagcaaaccggctttcaacctcttcttgcctaacatcgaaaccgccatactggccaagctgggaggcgtcccctggaggctcaagagggacaccacgaacgagttgatcgttggcgtgggtgctttctactcaatcacgcggaagtccaagtacgtgggctctgcattttgcttcaataacgagggcatctttaaggggttcgactgtttcggtgccaatgacaccgacagcatcgcgggctctatcagggaggccgtgggaaagttcatcgcgtctaattacaaggccacaaggctgatcattcacttctataaggacctgtcaaagaaggagctcaaaccaatcatcgatacacttcacgccctgggcttgcccatcccagtgatagtcgtgaccatcaataaaaccgagagcaaggaactcctggcatttgataccagctcacaaaagctcatgccctactctggcaccatcgtgaaggtgggagccaaggagtacctgctgttcaacaacacgcgatacgaggaagcatccgccccaacggatcgcgagcaccacttcccggtgaaaatcagctttttctcagacaaggcggagctgttggacgatcccgcactgatcaaccaactgatcgaccaggtgtaccagttcagccgcatgtattggaaaagcgtgagccaacagaacttgcccgtaaccattaagtatcccgagatggtggcggagattttcccatactttacccacgataaattgcccgatcatggaaaggagagcctgtggttcctg

SEQ ID NO: 197 - DNA, 1920 bp, Artificial Sequence
  Description of Artificial Sequence: Synthetic polynucleotide
atgtatcttaacctctacgaaatcaagatcccctacagggttaaacgattgtactacttcaataaggagaacgaccccaaagagttcgcccggaatctgagccgagtgaacaacatacggttcaacgacagtaaggacttggtgtggctcgaaatccccgacatcgacttcaagattacaccccagcaggcggaaaagtacaaaatagaaaagaatgagataattggggagaaggaagacagcgatctgttcgtcaaaaccatttacaggtacatcaaaaaaaagttcatcgacaataacttctactataaacggggaaataactacatttcaatcaatgataagttcccgctcgattctaatacaaacgttaatgcgcacttgacatataagattaaactgtacaagataaacgaacggtattacattagcgtgcttccaaaattcaccttcctcagtgacaagccagcccttgagagccccatcaagagcacctacctgttcaacattaaaagcggcaagacgtttccctatattagcgggctcaacggagtcctgaaaattgacctgggcgagaacggcataaaggaggtcctttttccggagaactactatttcaactttacctccaaggaggccgagaagtttgggttttctaaggaaatccataacatctacaaggaaaaaatcttcagcggctacaagaaaatcaaacagagcttgtatttcctcgaagacatcatcaatataaacaattacaaccttaccatggacaaaaagatctatgtgaacatagaatacgagttcaaaaagggcatcagcagaaacataaaagacgtgttcaaatacagcttttacaaaaatgaccagaagatcaaaattgcgttcttttttagcagcaagaagcaaatctatgagattcaacgcagcttgaagatgctgttccagaacaagaatagcatattctaccagaccatctacgagatggggttcagcaaggtgatttttctccgcgagccgaagactaacagcagcgcatttatgtataaccccgagaccttcgagattagcaacaaagatttctttgaaaacctggaggggaacattatggcaatcattatactcgacaagtttctgggcaatatcgacagtcttatccaaaaattccctgagaacctcatccttcaacccatactcaaagagaaactggaaaagattcagccgtatatcattaagtcctacgtctataaaatgggaaactttattccagagtgccaaccatacgtcataaggaacctgaaggacaagaacaaaaccctctacatcggcatcgacctgtcccacgacaactatctcaagaagtctaacctcgccatcagcgccgtaaacaacttcggtgacattatctacctgaacaagtataagaaccttgagttgaacgagaagatgaacctcgatatagtcgagaaagagtacatacagatcctcaacgagtactacgagcgcaataagaattaccccgaaaacatcattgttttgcgagacggacgctatctcgaggacatagagatcataaagaacatactgaacattgagaacatcaagtacagcctcatcgaagttaacaagtccgtgaatatcaactcctgcgaagaccttaaagagtggattatcaagcttagcgacaacaatttcatatactatcccaaaacgtactttaaccagaaaggtgtagagataaagataatagagaacaataccgactacaataatgagaaaatactggagcaggtgtactcactgacgagagtggtgcatcccaccccctacgtaaactaccgcttgccctaccccctgcaagtcgtcaacaaggtcgcccttaccgagttggaatggaagctttatatcccttacatgaaa

SEQ ID NO: 198 - DNA, 2211 bp, Artificial Sequence
  Description of Artificial Sequence: Synthetic polynucleotide
atggaggcgtacataacggagatggtgtccagggagagggccaacgagctggaggtttacgtgtacgtgtttccacggaagcaatccgacaacaactacgagggtgtgtatcacataatgagggcgtggcaacgggctaatgacctgcctctggcgtataatcaacatacgatcatggcattttcccccgtgaggcatatgtgtggctacacgccgatggagacgcagaaacgccatattaacattgactccccattcgagagagccctgctggagcgactgataaagaacagcctgatttttacagccgagcgccatttgcatgccaagcgggtaggccatgcgcttcggctgaaccaggtgcagcaaatccggcaggtgatcatctatgaggccatcgagctctatgtaaatatcattgagaatagaataagcatcggctttcacctcacccaccagttcgagtacgtatacactctccagagcatgatagaacagggaaaaacaatcagacctggaatgcgcgtcgtgcattctaacggaaggcagcattatacctacaccgtggagaacgtagcaacatatggggtgaccgacagatgcccgctgctgcagaccagcatttaccaatactacgtcgaaaaaggcgcgcagcacattttgcgcaccttcacccgatccaccagggtgatccacgtaagaacgaaagagcagaggttgagctacgcggcgacactcctgaaaccgctgtgtacttttgagaccatgcaaccccaggacgtgctcaatgtcagcaagtgcatcaaacttagcgcgagcaaacgaatgaaatgtacttacaggtggattcagcaactccgggcacagtaccgacacctgacctttgcgccgaaccccttcacgatcgcccagaatggctataaacttgatcagctcagcacccccaaggtgcacttccacagagactacgccaccgtcgtgagcggaatgaagaccggcaagctttacaaaggcggtaatatcaagatcagcgtgctcttcgacgaggacttttacttgaaacaccacatcaccaagaaggacatatatcaattcattgcagtcctgcagaaaatcgccatcgcacaaggcgtgaacatgaccataagcacgagcaccaagtccattacgggcaagttcacggacgactttttccaccacttcaccgaggaggtcgaagcactgcagcccatcttcgcgcaaaccacagttctggcattcattaccagtacccacctgagcaacaagaaaaccaggagttaccagctgctgaaacagtacttcggcggcaagtgggacattgcctctcaagtcatcacggagaagacgattgaggcgttccaaaaaatcttgcacaagcacggcctgaagaatttctaccccaatgacgaacagcactgtctccgcgtgatcgatgtcctcaagaatgagagcttctactacacggtcatgaacatcctcttgggagtatatgtgaaaagcggcatccagccctggatccttgctaatacaacccactcagactgcttcatcggcatcgacgttagccacgagaacggaaactctgcggctgggatgatgaatgttatcggcagccagggccaccttatccaacaggcgcccctgaacggcatattggcgggagaaaagattgacgacaccctgctcgcaaacttgcttaaacaaatgattaaggcataccacacccagttccagcgctttcccaagcatataacaatccacagggacggcttttggagagaacacactgcactggtcgagaagatcatgagccactatgagattacctacgacatcgtcgagatcatcaaaaagcctaataggaggatggctttcttcaacagcgtggacaacacctttagcaccaggcaggggacagtgtaccaacggggcaacgaagcctttctgtgcgccactaaccctcagcagaaagtgggcatggcacaaccaatcaaaatacatcaggtgaccaagaccctgcccttctcacacatcatagaagatgtctacaacctcagcttccttcatattcacgctatgaataagatgcgactgccggccaccatacattatgccgacctgtctgccaccgcttaccagaggggccaagtgatgcccaggagcggtaaccagacaaatctgcctttcgtg

SEQ ID NO: 199 - DNA, 2247 bp, Artificial Sequence
  Description of Artificial Sequence: Synthetic polynucleotide
atgaccggcgagactaaagtgttggtcgggaggcaacccttcgacgtggatcggctgaatgaactcagagacgaattccgggagacgcacgtgttcagaagggatggcatcgacgatgtcattgttgatgttccggtcgtggccggacagaagcccatcggcaacgtccaggaggaaatagacctggctaggtaccaaaaggtgtggccctccctcctcagtgctgctcttgtccgggcgtttagcggcgtaagggacatcctgagcgataggcccgtgagcgtggtggggagcacactgcggggtctggttcaacatccggaactccccgaatggatgcagaaacgcacactccttaggttcgacacccggaccatctatgctggtgataaaagaacctttggcttggtgtgcgaggccagattgaaaaaccttatccaaggtagttgcgcggagctgctggcacttggagtttccccactgggtcgatatgtccaagtcgaggagccacattacgatcccaggcttatgaaaaaacggcgccttgtgggcagggtatcagcgatctccggcgataatctggtgctggaggaccatgccgagggctttccgaccgtgagtgcaaagctggcatttctggaggcgcgaagggagatttttgacgactgtgtgcggaggattttgaactctgatgcggcctccgtgctgaacaaggccgaagctactgctgcctcatttcactcagggccaggtaggaaagagcaaatagaggaggctctcaagtatctcagggagaaggtgagcctcgaagctgtacccggagcgaaattcgtgatcgggccgatgctgagtagcggcaacaagggcttccccatcacggagatgatcccgaaacccattctcgtgttcgatccgagcggtacacggaaggatgagtggaacgaaaggggcattaagaagaacgggccctacgaccagaggacgttttcacctaagcagttgaaggtggcggtcatttgccaggcgaagcacgaggggcaggtggatggattcatcgcgaagttcttggaaggtatgccagacgttatgacgggcaagaaccgagttgctagatatggtgacggttttctgcggcgattcgcccttgagaaaccttctgtgaccttcttcacagcgccctcagccaaggcgagcgattacctggtggccagccgggctgcgctgaccaaggcaacggacgagggtttcaaatgggacctcgcgcttgtgcaagtggaggaggagtttaagggattcgacgacgagagcaacccctactatgccactaaatccgtcttcctgaagcgagacgtgccggtccaaagtgtacgactcgaaaccatggctcaggccgacagccagctgattttctctatgaaccacatgagcctggcgacatacgccaagctcggtggtaccccctggcttttggcgtcacagcagacggtagcgcatgaactggttatcggtcttggcagccacagcgtggccaacagcaggatcggtagccagcaacgattcgtcgggattacgacggtgttctcctccgacgggagctatctgctctcagaccgcacggcggttgtcccctatgaggagtatgcgactgcgctttacgatacgctcaaacggagcatcactacggtgaggaaacaagacaactggaggtctacggataaagtccgcctggtgttccacatgttcaagccccccaaggacaccgaggccgaggctataaaacggacagtggacgatctggagctggagaacgtgactttcgccttcgtgcacatcgccccatctcatccctacctcatcttcgacaatacacaaaagggaattggtttccgagaccccaagaaggggatactcggacccgagagaggtctgcacttgaagctgggggactacgagtccttgatcgtattcagcggcgcaagcgagctgaaacaggcaagtgacgggatgcccaggccatgcctgctcaagttgcaccggcttagcacgttcactgacatgacgtatctggcgcgacaggcattcgagttttcaggtcattcatggcgaatgctctccccagaaccgttccctataactattaggtactccgacctgatcgccgaaaggctcgcaggtctcaacgccgtcccgggttgggacgcggaggctgtcagattcggccaaatcggccgcacgctctggtttctg

SEQ ID NO: 200 - DNA, 2142 bp, Artificial Sequence
  Description of Artificial Sequence: Synthetic polynucleotide
ctgaaaatcaaaattctcaaggagccgatgctggagtttggcaacggcgctcacatatgccccaggaccggtatcgaaaccctgggagtgtacgataagagagatgaactgaggaggagcgagctgcgaataggcattgtgggtcggggcgagggcgtggaccttctggatgagtggctcgacaagtgcaagcgcggcatcgtgggtaaagaggagaccaagttccccaacttgttcaggggctttgggggcgtcgatgagtaccacggtttctacaccaagattctgagcagcccccagtatacccggactttgcagaaaagcgagattaacaacatcagcaagatcaccgcccgagaggacagggtagtgaagtgcgtggagctgtactacgagcagatccgattcctgtcagagaacaggagcattgacgtgatcgtgtgcgtcgttcccaatgatattttcgacagccttactaaggccaccggagacaaagacaccgagtccctggaggcctacctcgagcacaactttagacggttgctcaaggcccgctgtatgcaccttgggatacccttgcagcttgtgagggagaagaccatcctgagcgtgaagcctagcatagaccagcaggaccttgccacaaaggcttggaacttctgtacggccctctattacaaggggaataggactgtaccatggcgcctggtggaggataaattcaagcctaagacctgctacatcggcattgggttctataagagtagagacggcgaaacggtgagcacatcacttgcacaggtattcgacgagttcggccacggggtcatccttcggggagcaccagttagcctggacaaacgagacaagaggccctacatggacgagtctcaggcttacgaactgctggacagtgccctggcggagtacgagaaggccctgatgcaaaagcccgctcgagtggtgatccacaagagcagcaggttccggcccaccgaggtgagcggcttcagcagagtgctgaacgcgaaaggaatcagaacgaaggacctcgtgagcatcacatcaaccgacatccgcctgttcagcgacaaaaactatccccccacccgcggtaccttgttgtccctgtctgaaacacaaggagtactgtataccaagggaatcgtagatttttacaagacctatccgggcatgtatatcccttcacccctgagggttgaggcgttcgagtccgacagctctcttgaagacttgtgtaaggaaatcctgggcctgaccaaaatgaattggaacaacacacaactggacggccgactgcccattaccctggaatgcgccaataaggtgggcgatatcatgaagtatgtggacgcatccgaaaagccacaggttggtgtggcgctgtttatcttcatgttggagcaactcgtacccggctggaagctgcctaaggtgagtacatgggtagcacgggtaattttcctgaatattgtacaggtgtctatcgctctgcttgccgggattacttggaataaatggatgatgggccacagtttgttgcataccagcgatgccctgccccccttgctcgcaggattcgccgcctacttcgttaacaccttcgtgacctactggtggcacagggccaggcacgccaacgacaccctttggcgactttttcaccaactgcaccatgcgccccagaggatcgaggtgtttactagcttctacaaacacccaacggaaatggtattcaactctcttcttggcagtttcgtggcctacgtcgttatggggatctccatcgaagctggcgcgtattacatcatgtttgcggctcttggcgagatgttctaccacagcaacttgcgaacaccgcatgttctcggttatctctttcaacgccctgagatgcaccggatccaccaccagagggaccgacacgagtgcaactacagcgatttccccatctgggacatgctcttcggcacctacgaaaatcccaggagaatagacgaaccacaggggtttgccggcgacaaggaacagcaattcgttgatatgcttttgtttagggacgtgcattccctccccgggaagacacaaccagctcccgtactcgtcaaacccgacgtgagg

SEQ ID NO: 201 - DNA, 2550 bp, Artificial Sequence
  Description of Artificial Sequence: Synthetic polynucleotide
aaagggcggcaccaggcgaaacactacgcggacggcctggaaaaaatgcacgggcaaaggcctgtgattttctacaccaacggccacgatatatggatatgggatgaccatccggctcagcactacccgcccagacggttgtacggattctacgcgaagtccagcctgcagtatttgataaggcagcgcagtgaacgcaaggcgctgaatacggtgagctctaaaaccgatatactcggagaaagactctaccagcacgaggcactgaagcggatctgcgaacgcttcgagaccaagcagaggaaggcactcgcagtccaagcgaccggcacggggaaaacccgcttgtccatcgcacttactgactcttgcatgaaggccgggtgggtgaaaagggtgcttttcctgtgcgaccgaagggaacttagaaaacaagctaagaacgcctttagcgaattcctcagcgcgcctattagcgtactgacaacgaaaagtgcgcaggatacccacaatagaatcttcgtggcaacctaccccgcgatgatgaaggtgtacgagcaactggatacgggattcttcgacctgatcatagccgacgagagtcaccgaagtatttacaacatctacggcgacctctttcgctattttgacgcccttcaagtgggcctgaccgcaacccccgtggagatggtatctcggagcacctgccagctcttcgggtgtgactttaagcaaccaacttctaattacacactcgaaacggctgtggaggagggttatttggtgccctaccaagtcgtgaaacataccacaaagtttctgcgcgatgggatcaagggccacgcgcttagcgcggaggaactggcggagctggaggacaagggcatcgatcctaacactcttgatttcgacgccgagcagatcgaccgagcgatctacaataaagacaccaatcggaaaatcctgcagaacctcatggagaacggtatccggcaggccgatggccagaccctcggtaagacgctggtatttgctaggaaccacaagcacgccaaactcctcgaacagttgttcgacgagctgtacccccagtacggcggtaagttctgtcaggttatagacaactacgaccccagggcggaagagttgatagacgattttaagggcgagggcagcaacgaacagctcactatagcaatctcagtcgacatgctcgacaccgggattgacgtcccggagatcgtaaacctcgtattcgcacggccggttaaaagccccgtgaaattttggcaaatggttggtcggggaacgcgactctgtaagaatttgtttggacccggcaagcacaagacgcacttccttattttcgaccactggggagtcgtggagtatcacggcatgaaacaacgcgaggtaactgtgtcccagagcaagtccctgatgcagcaattgtttgaaaatagattggagctcgccaagaccgcgttgcaccacgccgaagccgacttttttgagacgatggcggggtggctgcacaaaacgataaatagcctggacgatcgaacgattgccgtttgtgataagtggaaaactaagcagcaaatgtccgacctggagacgcttagacagttcggtgcaaacaccgtcacgctgcttgagtcagaaatcgccccgttgatgcaatggctggatgtcagagggcatagtgacgcatatcagtgggacctcctggtctcacagatccaacaacaaaaattgaagcaggcggcagccttcgatgatctcgctgggagggcaatcaatcaactgtggcagttgcagatgaatttgaatcaagttaaggcaaagtccgagtggattaagcagtgccgagagacggagtggtggcagaaggcgtccctggatgaactggaacaaatgcgacaagaactgcggggcattatgcagtacaggaacaagggtgacattccgaagacagaggcgcccatcatagacataacggactcagaggaggtgcgcgagaaacaatcctcctacctgaactcagttgacatggtcgcgtatcgggtcaaggttgaacaggcgctccaggagctctttgagagaaaccccatccttcagaagatccggaacggggaggccgtgtctgagcgcgagcttgagaacttgaacgctctcgtgcatacacaacacccggatatcgatctcaacacacttaaaaagttctatgggaccgcggctccgatggatcaaatccttcggacaatagtaggcatggacgggaacacggttaatcagcgctttgcggcgttcatacaacagtacccctcactgagtgcgcgccaagttcaattcctgtccctgctgaaacgacaaattgctcagagtggggccatagagattgacaacttgtacgaaatgccattcgcagctatcggcgaacccgacagcgtatttagtaacgcggaacagattgatgaccttctggcgattgtggagagcttcgggaagcagccccagcagcagtctacgagacaggccaatgagaca

SEQ ID NO: 202 - DNA, 3138 bp, Artificial Sequence
  Description of Artificial Sequence: Synthetic polynucleotide
atggattacatacttgaattcgacgagtttattcgaagcatcaagcagaatattgatacaaagtattcattcctgttgggggctggcgcttcagtcgaatcaggtattccgtgtgccagcgaatgcatctgggagtggaagagggatatcttcatcagccaaaatccgaccctggctgagatgcacaacaacatcaagagccagaacattaagcgcagcatccagaactggctcgataaccagggcacctacccaaaggagggcgaggacatcgagtattcctactatattgagaaggctttccggattcccgacgaccggaggaagtatttcgaacgaaacatcaccggcaagactccgtcactgggctaccatatcctgtgtctgctggcggaacgcgagataatcaagtccgtttggacaacaaacttcgacggcttgatcattaaagccgcccataagtaccagttggtgcccatcgaggtcaccctcgagagccaagatagaatctatcggacggatgccaacaaggagttgctttgcatagccttgcatggggactacaagtacggtccgctgaagaatagtaaagaggagctggacagccagtctgacatcttcgtgaatgccctttccttcgaggcgtctaagcgctattttgtggtgatgggatacagtgggcgcgacaaaagcctcatgcaggctattgagcgaagcttttgcagaagcggcgctggccgcctttactggtgtggatacggccggaacatcgcgcctgaggtacgcgtgctgatcgagaagttgaacttgtatggacgcgaagcgttctatattcccacggacgggtttgacaagacgatgttgaacatagcccatatgtgtttcgaggataaggaattgcaggaagaagtggagaaactcaaagcggatctcggtgcggggtatgagtgtcgcaccaccacgttcagcccctacaaggaaggggtgaataagatcgtggacacaaatgtttacccgatcaaattccccgacaagtgctatcagttcgaggtgaagaacagcagcgtaatgaacctctgggattactgcaagcagctgatagactataacattgtggccgtcccctataacggaatgatctacgcctggggaaaccgcaacagcatcagcaacatgtgcggaccaaatgtgaacgggacgatcgaactcgttcctctcactaggaaaatctttttcgacaacggcactctcaagtcaatgctccttaaaactttgctcatcgtgattggaaagcactccaattgcaagtataaccgaaacaaaatctggcgagagtccaagaaaatcaactacactattaacggcaaaaacattgaagcgtaccaaggcattaggtttagcttgttcatggactggaaatacagctacctcaccctgacccccgctttctactacaaagacaggaacaacgttagcaaggaggagaacaaagagttcagcgaccggtttatggagcaaatatgtaagatgcaagccaataagaattacgccgcgtacataaaacactggattaacattatctttcctgatggcaagtccatcatttccatgtacccgtgtaacagcgagagcggattcgagttcaccattgttaataagtcactgctggtcggactgcggagtaggcaagcactgcataatcctgacgatgacatgaagaaacggatttgcatcggtggagctgagttggcggacaccgagctcaagttctacaatccggctcagaatgcaatgcacaccgacttccaccccatgaggggccttatcaacaataagccctacgacttctacatgaataacaggctgtttaaatctaacatctccctgggcgtgatctctcctgtgggttcagagaaaaagctggaggacttcctggaccgactcaacaaaaagcacaaagtgaactacaacgtcgactatgtcatagattatcctgggtttcagtccgtctacggggttggcctttctgtccctctgatcgcagaatgggcgttgttggatgataaaatgctgaataaagccaacctgtatcagagctgccttaacttcggggatcagatcaagaagaagattgagtacctgaagagccgcgacagcgtggacgtgatcatcatatacattccgaaagagtacgagctgttcaccttcttcaacgacggaaatatccattatgacctgcacgactacgtgaaagcattcagcgtgcagaggcacattagcacccagttcatacgggagaaaacaattgactctgagcttgactgccagatcgcgtgggccctcagcctcgctatctacgttaaagcaggccgcactccgtggattctcagtggcttgaggactgataccgccttcgccggcatcggctatagtgtggaccatataaagaccgacaaccagacccttatcggctgtagccatatttacggggcagatggccaaggtctccggtacaagctctccaagattaaggatgtgaccttcgacagcaagaacaatccctacctgtccgaaaacgaggcctaccaactcggcctgaatatcaaggaacttttctttgatagcttcaagacgttgccccaacgagtggtcatacacaaaaggtttccgttccagaagcaggagatcgatggcctgactaagtgtcttgggtccgcgggagtgaaagacatagacctcatcgaaatcaccttggaggatcgatttaggtgctttgaatacgacaggcgactccagattgacggctaccccgtgaggaggggcgtgtgcttcgccatcaacgagaacaccgcctatctgtacacccacggtattgcaccaagcgtcaagaatgccaatctccgctacatacagggcggtaagagcatccctgcccccctgaaaatcgttaagcactacgggaacggcgacctggcccaaattgcgacagagatcttgggcctgtcaaagatgaattggaacagttttggtctgtatagcaagcttccgtgcactatccaatctagcaacgctatcgctcgcgtagggtggctgctctcccagtatgagggcgtagtttacgactataggaatttcatg

SEQ ID NO: 203 - DNA, 2235 bp, Artificial Sequence
  Description of Artificial Sequence: Synthetic polynucleotide
atgaacaatctgatgctggaggcgtttaagggcattggcaccatcaagcccctggtgttctataggtacaagctcatcggcaaggggaagattgagaatacctacaagacgatcagcaacgccaagaataagatgagtttcaataacaagttcaaagcgacgttcagtaagggagagaccatctacacccttgagaaattcgaggtcatgcccaatcttaacgatgtgaccattgagttcgacggagaagaggttctcccgataaaagacaataatgaaatttactccgaagtcgtgcaattttacatcaacaataaccttcgaaagatcaaactggataacaaatatcagaagtatcgagcaacgaataccagagagataactggcaacgtcatactcgacaaagacttcaaggagaagtacaagaagtctaagtcagggttccagctcaagcgcaaattcataatttcccccaaggtgaacgacgagggtaaggtaaccctgttccttgacctgaacagcagcttcgactatgacaaaaacatttaccagatgatcaaggccgggatggacgtggtggggcaggaagtgattaatacgtggaataataagaagcagaagggcaagattaagaagatttctgagctgacgatctcagagccttgtaacttcggccagtcccttatcgattactacgtttccctcaaccaagctgtgagggtgaagaactttacggaagaggaaaagaacacaaacgttatcgtcgtccaggtgggaaagggcgaggttgagtatattccgcacgcgctcaaacccatcattactagggagtacataaagaaatacgatgaggccttcagcaaagaggtagaaaacctgatcaaaatcaacatgtcatacaggtacgaaatactgaaaaagttcatcgacgacatcggctctataaccgaactgaacaaccttaagtttgagaacacgtacatagataacatcgagtcactgggctaccaacagggaaagctgaacgatcccgtgctgataggcggcaaaggcatcctgaaggataagatacatgtgttcaaatccggcttttacaaaagccccattgacgaagtcaagttcggcgtgatttacccgaaaggccacaccaatgatagcaagtccaccatccgggcgatttatgatttttgtaccgacgggaaataccaaggcaaggacaacatcttcattaacaacaaactgatgaatatcaaatttagcaaccaggactgcgtgtttgaggagtacgagctcaatgacataacggagtataagcgagccgcgaataagttgaaaaacaacgagaacatcaagtttgtaatcgccatcatccccgcgattgatgagagtgatatagaaaatccctacaacccttttaagcgggtctgcgccgagttgaatctgcccagccagatggtaagcctgaagaccgcgaaaagattcggcaccagcaagggtaataacgagttgtattttctgcataacattagcctgggtatcttgggtaagatagggggggtcccttgggtcattaaggacatgcctggggaagttgactgcttcgtgggcctggatgtgggcaccaaagagaaagggatccactaccccgcatgcagcgtccttttcgacaagtacggcaagctgattaactattacaagcccacaatcccgcagagcggcgagatcatcaagacagacgtgctgcaggagatcttcgataaagtgctgctgagctacgaggaggagaacgggcagtatcctcgaaacatcgtgattcacagggacgggttcagcagggaggacctggagtggtataagaactacttcatcaaaaagaatataaacttcacgattgtagaaatcaagaaaaacttcgccacccgcgtcgcgaacaacataaacaatgaagtgtccaacccatttaaagggagcttcatactgcgcgagaacgaggccatcgttgtaaccaccgacatcaaagataatatcggcgctccgaaaccaatcaaagtcgagaagacatacggcgatattgacatgatgaccataatcaaccagatctacgccctcacgcaaatccacgtcggaagcgcgaaatctatgaggctgccgatcacgaccggctatgccgacaaaatatgtaaatccatcgaatacatcccgagcggtagggtggacaaccggctcttcttcctg

SEQ ID NO: 204 - DNA, 2253 bp, Artificial Sequence
  Description of Artificial Sequence: Synthetic polynucleotide
atgggcaggcaactccaactgaactttaccccgctcagggttaggggcgacgccatcagacttcaggcgctgcctttcgaggacgctcaacaatttaggaatctgcgcgatgagcatcgagcacactacgctgtgacgagaaggagcgaccacatcgtggccctcccacttacactgaatgcctccccaatcggcgaggagaagatcgtgagcgttgtggagcatgcgagtttgattcggcccctgcttgaacagaggttggtgacccttctgtccagtaaccggaggccggtggcccggtataatccgatcaccaccattggaagaaccttgccaacgggcttcatagaagccgaccgacacctccatttgcagtcccgcgtgcttattgctatccgctccctcaagctgccggacgccgagcccttgggattgctctgggacatcgaaatccagaaaacatgcgcgactagccttgccgtcctgcacgcacaaggggtacggctggacggtctcacagtggaacggcttgtcccggtggaggacgtgcgaatgttgccttataggcgactggtgggcagagtaggcgcgctgaccgatggccacgcccgattgagcgagcggttccagaacgtcgaagaattgctgcccctggacgagctttacctggaggccagtccggagaacctgaggcaccttctgcagcatttcatgcgcaacacaagcgggcgagtgcaagggaagatagacgagatcgtcttcgagaactcacggggacgcgctcggatggagcacattgcccggatctccgactggcttagaggcctgggcgagattgaactgcaggagggtttgtctgtaggcatcggaaacctgctctctgaaaaggacgcccagaactttcccaggttcactgagggaacgaccccaacctacgtgtttgacgctgggacgttgaagagcgagtcaagggccgcagtgggcctcagtaaattcgggccctacagccggcatgtatttacaccgactcgacccaacgtttgcgtcatctgcgaccgcgcaagaagaggacagtttgagctgttcctgcggaaattccgggatggcctgactgttgatgggaagtccctgccgtttggtcgcgggtttctgggaatatatggccttcaggatatcaacctgaccttcgtcgaggcggatgcattcaccgcggacgcgtaccatgctgccgcaagcaaggcagtacggatgggagccgagggcgcaccgtggcacctggcactcgtgcaaacagaacgcgacagtcggcaactggctccccccaagaatccgtatttggtagcgaaggcggcgtttctgtctaatcaaattcctacccagtttgtggcgttcgagacattttctatggcgcctctgaacctcgcgtacacactgagcaacctggcgttggcggtttatgccaagttgggcggcatcccatggctgatcaagagtgataaaggtatagcccacgaggtcgtcatcgggttgggtagtgccgcgatcggggagtcccgattcagccggaaggagaggattgtcggcatcacaagtgtttttcggggtgacggcgggtacctcttgtctaacctgtccaatgccgtgcccatgagcaagtacggcgaagcattgaccgaatctctccaggcgaccctgcagagggttcgcaatgagatgaactggatcaggggggacagcgttcgggtcatagttcacgctttcaagccaatgaggaacacggaggtggagagcgttaaggctgcgctgaaagaattcagcgagttcgacctgcaatttgctttccttcacgttaagcaagaccacccgtacctcctttttgacgacgacagcatcggtacaaaagggcgaggcgagaaaacccccgtgcgaggcttgttcgcggaggtcggacacaacgagacactgctgaccctgaccggaccacagcagctgaagagacccaccgacgggctgccgaaaccgcttctgctcagcctccatagggactctactttcacagatataatctacctcacgaagcaggtgtactggtttagcaatcactcatggcggtctttcctgccagcagcgatgccggtgacgatatactacagcgacctggtggctggtttgctcggaagactggataggctggggtctcgctggtcaccgagtgtaatgctgggcaagatcggaaccacaagatggttcctg

SEQ ID NO: 205 - DNA, 2853 bp, Artificial Sequence
  Description of Artificial Sequence: Synthetic polynucleotide
atggcctatccaatcgctgacgaccggcgaaagtacttccacagtcttttcgagaacaaggagccgtacatcggatacaaggctctgtgtctgctggccaagaacgacatcatcaagagcgtgtggacgaccaactttgacgggttgactgtgcggaccgcattccaaagtaacttgacccccatagaaataaccctcgacaacgcagacagactgtttaggaaccaaagcaagagagagctgctgagcatatcacttcatggcgactataagtatagcacgctgaaaaataccgagaaggagttggactcacaggacggcaccttcagcgagcatctgggtaactatcacgtcgacaagaacctgattgtgataggttattcagggcgcgacaaaagtctgatgaaatccctgaacgatgcattcaccaagaggggcaccggcaggctgtattggtgcggctacggtgacaagatcaacactgaggtggaagaacttatacgcaacgtacgaaccgctggaagggaagccttctacatatccaccgatggttttgataagacgctgatcgacctttctaaaagcgctctggaggacaacagcatgagcctcgaaagccttaattccatcctgaaactggcaaacaacgaggagctctcaaagatcgaatttagccagagcatcaccaggaccgacaaatacctgaagagtaatctgcacgcaattgtgttccccaaggagatattccagtttgaagtcgagtttggcgacaacaagccctggtcattccttaaagacaaaactaacaacaccgacatatgcgccatccccttcaagaggaaggtttacgccctgggcacgctcagcggtatatctagcgtgttcaaaaacgtgctcaaaagcgagattaggagggtaccaatctccaagttcgacatcgacaatgtgagcagctttaggtctctcatgatccaaacggtgatcaagcactttctgtcatacggaatcttcgacagcaacctcaaggacaaactgtggcttagaaattccgacaattccttcggggacaagaaaatacacaaggcgatttacctcagcttctacttcgataagagcagcaaattcggctacattagcttcagccccagcatacacataacctccgataacgagatcagcaaggaggtgaaacaaaggattagcaaagagatcttggaaaagctccgaaacgataagtttgacgaaatactggagtactggaacaccatactgttcaattacaaaaatcttaagttcgagtacccccttaacagcgggaccggattcgagttccaaataagccgaaacactgcgtttgccgaaatcatggtgctggacccgaactatcgagtctataaaccaagcgattacaacaacaagctgacccagttcagaggtgtgcagtatctggagccgcaactgatctttcagaactcactgagtaactcccacaccaaggactaccaccccatgagggcgttgaccaataacaggccatacgacaacaacttgaatggcatcatctattcaaacgaggtcaatttggccgtgatttgcggggaaaactactccaaaaacctctacgacttcctgaaccagcttaaccttaaacaccccacagacaacatcaaccccgatttccttatagaatatcctggcttcgcgagcgcctacaacctccccatcaacatcccatactatgaggacgcggacaagtggattaacatagatttggagaagagcaacaagtccgacagcgagaacgccatcatcgttgcacgcctcatcacaagcaaaatcgagcagatcataaacatacagtctcagcacaccatcgtcatcttcatccccaaagagtggcaggccttcgagagcttccaggaaaatggcgaggacttcgacctccacgactacatcaaggcgtttagtgcatccaagggcgtgagcacccagctcatcagggaggagacactgtcagacaggttgaaatgccaggtctactggtggctgtctctgagtttttatgtaaagtctctgcgcacgccatgggtcttgaataatcaggagaaaaacaccgcctacgccggcataggctacagcattaagaagaacagcaatgacaccgaggtggtgatcggttgcagccacatttacgattctaatggccagggcctgaagtacaagttgagtaaagtagataattacatcctggataagcagagcaatcccttcatgagctataatgacgcgtttcagttcggcgtgtcaattagggaactgttctacaatagcctggacaggctccccgagagggtggttatccataagcggaccaagtttacgaacgacgagataaaaggtattactgccagcctcaacatggcggggattaccaagatagatctcattgaaatcaactacgagacggaggctaggtttctctccatgaacgtattcaacggccttctgggcatagacaaattccctatcagtaggggtacctgcattattacgaataagtacgaagccctcctttggacccacggcatcgtgccctccgtgaagaatcccattcacaagtattacctgggcggcaggagcatcccagccccgatcaaaattactaggcattacggcgagagcgatctgaatactattgccatcgagatcctcggcctcaccaaaatgaattggaatagctttgacctttacagcaagctccctgcgacgattaactcctcaaatcagatagcccggatcggtaagttgctggcgcgctttgagggcaagacctatgattataggctctttatt

SEQ ID NO: 206 - DNA, 2268 bp, Artificial Sequence
  Description of Artificial Sequence: Synthetic polynucleotide
atgaacctgaccgtaaacctcgcccccatcagcgtgcagggcgactgctcagtcctgattggcagacagcgctacgacgagcagaggctggctgaacttaggtcagactttcggggcacccacgtgtttcggcgagacggtccagatagcatgattgacatccccgtggtccccgacgcggcacctctgggcaacctgagggagacgatcgaccttaggcggtaccagcggctgtggcccatgcttctgcaggagtccctcatccagctgcttggtaagcgccccatccagtccagcaagcccttgaagttcctgggagctaggtctcctctgatcgagcacccggatctccctgagtggttgaggcgggtgagcgttaccgagatccacacccgacacatcaccgtggacggcaagcaaatctacggtatcgtgtgcgatgtgagggccaagtcttttatcctcgccacctgcagcgaacttctgaaattcggcgtgaccatccttggtagatacgtccaaatagaacagcccgcgatagacgagagaaccatgcctaaaaggaagctcatcggcagggtaaggtccatccaaggggatgatctgcttcttgacgactgtgaggccggcttcgaaaaagtcgctgcgaatgaggcatttctcgagccgcggaaggaaaatttcgaggactgcgtgaggcaggtgctgaagcgggacgccgagagggtgttggagaggtcagctcgcgccagccaaaacctggccgcaggccctgggaaactggaacacatcgacggaatcatcaggtatcttagggagaagaagcccgcagcggtgcccggctgccatttcgtgatcgatgccatgctcaacacaaacggccacatttttccacccggggaaacaatggacaaacccttcctcttgttcgaccctagcggttcacggagagaagactggcccgagaagggccttaaagatcacggcccctatgatgagcaggtgttttcccccaagtccctgaagatcgctgttgtgtgccaaagccggttggagggcagagtggacgagtttctggcgaagtttctcaatgggatgccgaaggtctttcaacccggcaagagcttcgcccgctacggcgacggattcgtgaaacgattcagactgaacaagcccgaggtgcacttctttcttgcagatggcaactccgacgaggcatacgccgtggccagccgcgaggcactcgataaagcgagggatagcgggttcgagtgggacctggcgattgtgcaaattgaggaggagttcaagtcactggccgacggctccaatccctactacaccactaagagcatcttcttgcggagggacgttccggtgcagagcgtcaggctggagaccatgagcctgtcagataatgacctggtgttccccatgaaccacctgagcctcgctacctacgccaagctggggggcacgccctggctcctggctagctcacaaaccgtggcgcacgaactggtgatcggactgggtagcagcaccagctccgaatcaaggctgggcagccagatgagacatgtgggaatcaccaccgtgttcagcagtgacggcagctacctgctttctgatagaaccgccgcagtgcccttcgagcagtacccacaagagttgaggaaaacgttgcgaaaaacaatcgaggccgtcagggccgaggacaattggcggagtagcgacaaggtgaggttggtattccattcattcaagccgttcaaggacagcgaggtagaagccatagaggcgctgaccaccgacctgggcctgggcgacgtgaaggccgcctttctgcacattgcgcccgaccacccgttccttatcttcgaccacgaccaaatgggcatcgccgcacgagggggcaaaaaaggcgtgttgggccctgctaggcagttgcacatccggcttagcgacgctgagagccttgtggtcttcgcaggggccagcgagcttaaacaggtgacggatggtatgccgcgacccgcgctgctcaagctgcaccccaaaagcaccttcaaagatatgacctacctggcaaggcaggcctttgcctttagtgcccatagctggcggatgctgtcccccgaacctttcccaattactatccgctacagcgacctgatcgccgaccgcctggcgggactcgcgtctgttaagggctgggaccccgatgccgtgacgttcggcgctatcggtcacaagccttggttcttg

SEQ ID NO: 207 - DNA, 2424 bp, Artificial Sequence
  Description of Artificial Sequence: Synthetic polynucleotide
atgataatgagcctggagagcaatatcttcacttttagcaacctcgggacacttaccacgcagtaccgactgtatgagatcagaggcctgcagaaaaggcaccaagagtactaccagaacaggcaaatcctgatccaccgactctcctaccttctgaaaaatgccgtaactatcatagagcgcgacgagaaactgtaccttgttgtagctgccgatgccccggaaccacccaatagttatcccatcgttaggggcgtcatctacttcaagcccaccggccagattctgaccctggactacagcctccgaacaccccagaacgaagagatctgccagaggttcctccatttcatggtacaaagtgccctgtttcaaaacgcgaatttgtggcaacccagcgccggaaaggctttcttcgagaaaaagccctcattcgagttcggatcaattctgttgtttcagggatttagcgttaggcccatattcaccaaggacaagatcggcctgtgtgtagacatccaccataaattcgtcagcaaagaacccctccctagctacctgaacttcaacgagttccaaaaatacagaggcgtgtcatgcatctaccatttcggccaccagtggtacgagatccaactctctgaactctccgagcttaacgcgacggaggcaatggtacccatcgagaataagttcgtgacccttattaactacatcacccagcaagccaggaagcccatcccggaagagctggcaaacgtgtcacaggacgcagccgtcgtgcactactttaacaatcagaaccaggacaggatggcggtgacgagtctgtgctatcaggtttacgacaactcttatccagaaatccgaaagtaccaccagcacaccattctgaagccacacatccgccgcagcgcgatccacggaatagtgcagaagtatctcgcggagctcaggttcggcgacataaccctgaaggtatcaactatccccgagctggtgccccaggagatgttcaacctgcccgactattgcttcggcaacgattacaaactgagcgtgaaaggaagcgagggcacagcccagattagcctcgaccaggtcgggaagcagcgccttgagctgctgagtaaggctgaagctggtatctacgtgcaggaaaagttcgaccgccaatacattctcctgccccaaaccgtgggggacagcttcgggagccggttcatcgacgacctcaagaagaccgtggacaagctgtaccccgctggaggagggtacgacccgaagatcatttactaccccgaccgaggtctccggacctacatcgagcagggtagggctatactgaaaacagttgaagagaacgagctgcagcccggctacggtatcgtaatgcttcatgacagtccggatcgactgctcagacaacacgacaaactcgcagctctggtcattagggagctgaaggactacgatctgtacgtggccgtcatccacagcaagaccgggagggagtgctatgagttgagatataacaaccagggcgagcccttctatgcagtaatacatgaaaaacgggggaagctctacggctacatgagaggggtggcgctcaataaggtgcttctcaccaacgagaggtggccctttgtgctttctacccccctgaatgcggacgtggtgatcggaatcgacgtcaagcaccacaccgccggttacatagtcgtcaacaagaacgggagcaggatctggactctgcccacgatcacgagcaagcagaaggagaggctgcccagtatccaaataaaggcgagcttgatcgagatcatcactaaggaggccgagcaaacagtagatcagctgcacaacatagtgatacatagggacggacgaatacacgaaagcgagatcgagggcgccaagcaggcgatggccgagttgattagcaggtgtacgctgcctgtgaacgccacactcacgatcctggaagtggcgaagagcagccccgttagctttaggctgtttgatgtctccaataccaattctaaggacccgtttgtgcaaaacccacaagtcgggtgctactacattgccaacagcactgacgcctacctgtgtagcacggggagggcgtttctcaagtttggcaccgtgaaccccctgcacataaggtatgtggaaggtacgctcccccttaaactgtgtttggaagacgtgtactatctgacagccctgccttggacgaaacccgacgggtgcatcaggtaccccattaccgtaaagatcaacgacaggaggcttggggaggacgccagtgagtacgacgaagacgccctgcgcttcgagctgttcgagtctctcgagtccgaggatgactttgacgagatgaccgacagcgactttaatcaggaggagacaatggtg

SEQ ID NO: 208 - DNA, 1872 bp, Artificial Sequence
  Description of Artificial Sequence: Synthetic polynucleotide
gtgggcgacaagaccttcagcttcaaggtgtataggaaactgaaacagcagaacgacaccaaggaagacgagatatacctttacaatttgccccaaggcgagaccctgaatgattacaagccatattggatcagttttaccccgaaggacggattcgaagaatacatcgctaattcttacttgagcatcggcctgtcaaaaaagtacctgttcaatagattcgtggagacgctcagcaactcaaaactgcacttcacctacaaggtcaaaaggaaattcaccgactggtacgtcgatttcgtaatcgcgcagtacagccagggagacaggatcatctacatgagcccctacttcctggaagagcaaaacacctacggcttcatcatcgacttcaagttcagcaagaaggatggtatccccttcgataaggaggtgcaaaagctgtccctttcactggatagcaacggccgcagcaacaaaaactattactctgacaaatttaggctggtgaacaatttcattaaggagatttacacctccataaagaacatcgggaccagtaataatcctatcaccatttccagcaacctcatagagaccaccgtgttccacctgaacaagaaagagtacatctttagcaataacaacgtaagctctagccagttccagggcgtgaggaatttcggtgtctataagaatatcccccaggacgtgatcttcgcgttcatattcgaggataggttcaggagcttcgccaacgagctgtatctgagccttaccggaaaattgaaccccgggacctttcccggactggagcagatgttcggcatcagcatcaacaccaaaaacgtgagacagatcaagttggagaactactctctggattcaatgcttagggtggtgaatgacgtgaagagcttgcaggagaacaatcccgataagaagatcgtgggaatctacgtggaagactgcaccatcgacagcgaggacatccctgcgtccaacaactactactttctgaagtatcactttatcaaaaatgacctgccactgcaggttgtgaattatcggaagctgggcgaaaggaattctctgaaatggagtacctccaacctggccctggccatgttcgcaaagatgggcggcatcccctgggtcgtaaaaccgtctaataagaactgcttgattcttggcatcggatctagtcataagataaaccgggagaccggcgatatacttaaatactttgcatacaccatatgtctcgactccagtggcctgtacaaggcccttgaggtgctggccgacgaggagagcgaggtgagctaccttgagaagcttactgccaatctggtcgccatactgaaggaacaaaagaccaattacggcacctgtgtgctgcacctgcccttcaagattaagaaaaaagaggtagccgccattagtgatgccataaaacaaatcaacgacatcgagctggtggtggtaaagatcaatgtggataacaagtatttcggatactccttccacaacacattggtgccctacgagagcagcttcgtgaagctttctaaggatgagtatctggtgtggttcgagggcctgctgtacggcaaagagatcgtagataagaggttgagcaaccccgtgcacatccaattcttgaacatcaccaacaggaagaacttcgatgagcaggcgtttctgcaggacattctgaatttgagcggagccaactggaggggcttcaacgccaaaagcatccctatctcaatttactattctcaaatcatcgcgaggtacaccgaggccttcgaaaacatcgacggttacaaggagggtactatctctaacgacaaaccctggttcctg

SEQ ID NO: 209 - DNA, 2211 bp, Artificial Sequence
  Description of Artificial Sequence: Synthetic polynucleotide
atgagcgtggcgatcgtgagcccccaaatgtacaagagtctgagcgaggtgtttcctctgaccgcctcccaactgaactttatgtgctttaggctgactcccgaaatcgaaaagaaggatggtaataggctcagctaccatttcagtctgaagctgccggaaactgttgtgatctggcaccagccctacttctgggtgttggcgagtagtaacaggcaaatccccaataaggacgagttgcaagaaactctgataaggatccaaaacgaggtggatgacttcaaagaacgactcttcggtttccagagcgttcgccacccccaactcaccccctttatcatcagcctcttcgccgtgcaggtcctcaaaaaaacaaagttcgactaccccattgcattcagcaacaacggtgtaatcgtcaggagggagcccgacttttggacggagagcatagagcttcaagacagcctgcatcctgccctcacgctgaccgtaagttcatcaatagtgttccgcgacaacctcgcggagttctatgaaaaacatcatcaaagggagaagcccgagcagtttctgatcggcctgaaggtgcaggaaatagagaggggcaacaatgcgatcatcgtgggactcgtcggcaccatcggcgagcaccgggaccagctgcttgaaaaagcaaccgggagcactagcaagcaggcgctgcgagaggcaccggacaaccagccggtggttgcgatacagttcggcaaggatacgaagcagttctactacgcaatggccgcgttgcggccgtgcgtaacctcagagacggcaaaccagttcgaggtagagtacggtaagctcctgaaagctacaaagataagccaccaggagcgaaccaacctgctggcctcatacaagaagacggcccaggagtcattggccgcttatggcatccgcctggagctgagtgtgaatagcagggattaccccagcttcttctggcaaccccccgtgaagatcgaagataccaaacttctgtttggcaacggcataaccggcaagcggactgaggtgctcaaggggctttctatagggggcgtgtaccgacgccacgggaaattccaggacaagtcaaaagtgatccagatcgcggctcttaagctttgcgacgtgaccgttagcttgttcctgaagcaacttactcaaaggctggcaaaatacggcttccgaagcgagataatcaccaagaagcctctgtcaatcaagaaccttgccaccgccgaagccagggctgctgttgagaaagcggtcaatgagctcgtggaaataccccacgacatcgtgcttgccttcctgcctgagtccgacaggcacaccgacgacacggatgagggttccttctatcaccagatctactcccttctcctcagaagacaaatagcctcacaaattatctacgaggacaccctgtccaactctgggaactaccagtacatcctgaaccaggtcattccggggatcttggcgaaactcgggaatctgcccttcattttggcggaaagcctcgatatagcggaccacttcatcggacttgacatcagcagaatctctaagaaaacgcaggtcgggacacgaaacgcgtgcgccagcgtgcgactttacggacgccagggtgaatttatccgctaccggcttgaagacgacctgatcgacggcgaggcgattccacccaagctgctggaaaggttgctgcctgcgaccgagcttgcgaataaaaccatactgatctacagggacgggagcttcgtgggcaaagaggccgactatcttgtggagcgagccaaggcgatagacgcgaagtttatcctcgtcgagtgtaagaaatccggcgtgccgcgcttgtataacttggagcaaaagaccgtgatcgcgccgagtcagggactggctcttcgactgagcagtagggaagcaatactcgtgaccaccaaggtgcccgataaagtgggcctggctagacccatccggctcacaatccacgaaaagggccatcaagtaagcatcgaatccgtgctggacactacactcaagcttactcttcttcaccatggcgcgctgaaagaaccgcgactgcccatgcccctgtatgggagcgacaggatggcatacctccggctgcaggggatacggcctagcgttatggagggcgaccgccaattctggctg

SEQ ID NO: 210 - DNA, 3156 bp, Artificial Sequence
  Description of Artificial Sequence: Synthetic polynucleotide
atggaagaaaatctgtatcttgaatacgacgctttcttgaggagtgtgaagcgcaacgtggacgtccctcatagtttcttgcttggagccggagcttccatctcctccggaattcagtctgcatacgactgtatatgggagtggaagagagatatctacatcacgaagaatataaacgccgccgagtactataaaaatcataaaaacgaaacggttcgcaaatcaatacagaagtggctggacaaccatggcaactaccccatcctggatgcagcagaagagtacacattttacgccgagaaagctcatccaatcgctgacgataggagaaagtacttctttagtctgattgagaataaagaaccatatatcggttacaaattgctgtgctttctcgcttcacaggggattgtaaagagtgtatggacgaccaattttgacgggctgattgtacgagctgctcaccagaataatttgacgcctatagaaatcaccttggataacgcggagcgcatattccgaaatcagagtactaaggagcttctctgcatagctctgcacggtgactacaaatatagcaccttgaagaatactgataccgaactggataaccaacacgaaatttttcaggagcacctcggaaattatcacgtagataaaaattttatagtagctggttatagtggacgcgacaagtctctgatggatgcactcaaggccgcttattccaagaaaggatctggtaggttgtattggtgtggctatggtgagaagataaattctgaagtgaaagatcttcttaagtatattagagcgagtgggagggaagcatactatatagctacggatgggtttgacaaaatgctcatacacttgtcaaaggcaatatttgaggatagccaagagctgagtgaaaaaatccagaaaatactcgaaagcacgaatcaaaccgagaccttcaacacagaattcaagttggagtttaaaaaaaccgacaaatatatcaaatcaaatctgcaccctattgtttttcctaaggaagtatttcagttgcagatcgagtatggcaatgaaaaaccgtggtccttcctgaaaacactgacaactcaaacgaacattagcgccgtaccgttcaaaggcaatgtctacgcacttggtacgcttagcgagatcaattccatcttcaagccgtatcttaaaagcgaggtcaagagggaagcgatcagccgattcgacatcgaaaacgtcaccgcattcaaaaacctcatgttgacagccatatccaaatatttttgctacacgaaagaagtgaactctaactacaaagataagatttggttgaaaaacatcctgtccaaggtgggggatatcactgttcacaaagcaattttcatatccctgtactttgacaagaattcccattttggttatatggcgttcgctcctaccgtttatttggattccgactgcgaaattgagaagagtcaaaagcaatccatcagtaagaatttgcttgagaagttgtataataacaaatataacgaagagctcgaactgtggaatggtatcttgtttaatcataagaaagtgaaatttgaatatcctcccttgtctggtacggggttcgaatttcagatatcaagcaacactgccttcggggagatagacgtgattgataacaagtaccgctcttacgtcccccagaattatgataataagcagactcagttccggggaatccagtttttggagccgcagctgatatttaagaacatcgcaacgaactctgacttcaaggattatcatcccatgcgaggactgattaacaaccgaccatatgatgtaaatctcaacgggattatccactccaatgaaattaacctctcaatcatctgtagccaaaagtatggagaaaggttgttcgcattcttgacacagctcaatagtaagcacagtacagaaaatatcaacactgactacctgatagattaccccggcttcctgtccgcctttaatctgcccatcaacatcccagccaccaacgatgacgctagctggatggacatcaacttcgtagcagataactctaaagaaacacacgagaacgctatacgactcgcgagggcaattaccaataagatcgagaagatttctgctatacaaagcgccagcactatagtaatctttatacctttcgagtggcagcccttcgaaacatatattaacgaaatagagacgtttgatttgcacgactacattaaagcgtttagcgccagcaaggggatatcaacgcaacttattcgggaggacacccttgacgataagctcaagtgccaaatatactggtggttgtctctttctttttacgtgaagagcctcaggaccccatggatattgaacaaccaggagcggaaaacagcttatgccggaattgggtactccataagcaaggtaaagaacaagtcagagatcgtgatcggatgttcacatatatatgattcaaatggccaaggccttaagtatcgcctctcaaaaattgataactactttctcgataagcaaaataatccgtacctgtcttataaggacgcttttcaatttggggttagtatcagagagctcttctatcagtcactcgattctctgccagaaagggtcgtcatccataaaaggacaaaattcaccgaggatgagatcaatgggataaaggcttcactcaaccaggctggtattaagaagattgatcttatagagatcaactacgatatagatgcaaaattcgttgccatgaacgtgttcgataacaaattgcaggtcgataaattcccgatatccagaggaacatgcattgtgacaaataaacggacggcgttgttgtggacgcatggtatagtaccttcagttaagcagcccaattataagttctacctgggcgggcgctctatccctgcgcccataaagattaccaagcatcacggagaaagcaacattgatgtgatagctagtgagatcctcggactcacaaaaatgaattggaatagcctggatctctacagtaaacttccctctacgatagattcttctaaccagattgctaagataggaaaacttctgtctcgctttgagggccgctcatatgactacaggctgtttatt

SEQ ID NO: 211 - DNA, 2217 bp, Artificial Sequence
  Description of Artificial Sequence: Synthetic polynucleotide
atggacaatttggctctctctgcgcttcagctggacagtagattggatcactgtatggtatatcaatacaggatcgtgtaccataagttcgacgaaacagaggcgggtgaaaaactggcaagaaaggccgcctacgaactgtggaaggtaaacaacttcggactgctcaccaacctgggtgccagtagcatcctgtcccttaagagcctgagtcagctgtctatcgattcaccgctgttgcaggcaagtttgaaagctgacggccagttggagctggattgcggtaacgaacagcatcaggaggcgctgcagagactcgtgaaccaggacataaacaaagcggcttggaacctcaaacaagcgagcgaggggaagcttgattgccgaaaatcaccaggcgggcacgccgaaatcttcgagccaagtcacagtagtcggatcaaggcccacagtacctatttggatgccttctgcaccgtaaggctgattcccgaagtgctgtcagacgggacagtgctgatagggttgcatcttaagcacagcctgaccgcgaaggcggacatctctcttcagtgggtcattgatcataggcccgattggctgatatccatagagaaggtgcgccacaggtattacgagcccggcaaagcacccctcgttgcggagttcgtgaaagtcgatgattccatcaacggatcatcccttctcccacacttgggcaaatcccttgtcgcttaccaccaggagaaagggctgctttcagccggacagctcgcagaggcagccaccagctcactcatcaaagtgcgctacggacagaaggaggcagaccacgttgctagcttggtggaacccatgtttgatttcgatactctgtcaaagattgacagccccttcctgaataggctcgccaaagacctgaagtggagcttggacgatagaataaagacaagcgcggagatggtcaagaggctctacctgcccgggtttaatcgaaagttggtacaagttgactaccagaatctgagcaggaagaggttcaaccacaaccttatgctccagttcgcggatggggcaaggagcggccatgaacaagacgtcctgaaatacaaggctttcgccgacatgaccagggctagggtaatcccactcgtggtaggagagaggaacaacaccgaaagcaatagacaattgctccggaacgcctataacgcactgaggcaacttaccaaggccgaattgccccccttcacgtcatttccccccagcatcggaaacgccgacgagttggacgcacggctgcacaagaaatgtcccgacaacgccatcctgcttatcgggctcacagagaagagtgacaaagccgcgatcagggacacggcgttcaactacggcctggccacccagttcatgaggctcgatcacaagcccaaggtttacgacagcttctacttcaataacgtcgcagcgggcctgttctccaagggaggagggcaactgtgcgccgtgaacgacatgcccggtgagactgaactgtttatcggtctggacatgggcggcgtgaatgtaagggcgccaggtttcgcattcctgtttctcaactctggcgcgcaactgggctggcagctggctgacaagcagcagggcgagaaaatgcaggacgacgctctcagcaatctgctggagaagtctctcaaaacctacctgaggagcaccgacgggcttttgccaaggaggataactctgcacagggacggcaggttttacgagagcatcaatgtgatagaacagtttgagcagaagcacggggtcaagctcgatgttctggaagtcttgaaaagcggagccccggtgctgtaccggagagaacgcagtgcggacggtaagaaagttttcagcaacccaggggttggcgatgccgtcttccttagcgacagggaggtcattcttagcacttacagcggcgaggaacttgggaagtcatggggtaacaaggtgagtgtgaggccacttcgactccgaaagagatacggcgagaccgcattgagcgtgttggcccatcaggtgttggtcctgtctaggatccatggggccagcctctaccgacacccccgacttccggtgaccacccaccacgcggacaggttcgcaaccttgcggcaagatgcgtgcatagacgcacttagtaagatggatagactgtgtccggtgtatctg

SEQ ID NO: 212 - DNA, 2232 bp, Artificial Sequence
  Description of Artificial Sequence: Synthetic polynucleotide
atgaataacgtgatgcaggagtttcccgtcgcaagcttccccacattcttgtccgagatcagtctgcttgacatcacaccgaagaactttatctgctttaggctcacccccgaaatcgagcgcaagaccggtaacagttttagctggcgcttcagccaaaaattccctgacgccgtcgtgatttggcataacaagtttttctgggtactcgctaagcccaatagaccaatgcccagccaggagcagtggagagaaaagttgctggaaatctgcgaggaacttaagaaggacataggcgacagaacctacgccattcagtgggttagccagccccaaataacccctgagatcctgtctcaactcgccgtcagagtgttgaagatcaactgtaggtttagctctcccagcgtaatttctgtcaatcaagttgaagtgaagagggagatcgacttttgggccgaaacaattgagattcagacccagatccaacccgctttgaccatcaccgtgcacagttcattcttctatcaacgacacctggaagagttctacaataatcacccttacaggcagaaccccgagcaactgctcatcggcctcaaggtgagggacattgaaaggaatagcttcgcgacgattactgacattgtgggcaccatagcggaccaccgccagaagctgctcgaggatgccactggagctattagtaagcaagcccttatagaggccccagaagagcagcccgtggtcgccgtacagttcggtaagaaccaacaacccttctactacgcaatggccgcgttgcggccttgtatcaccgccgagaccgctaggaagtttgacgtggactacggcaaactgctgtccgccaccaagataccctacttggagcggaaggagctgttggctctctacaaaaaggaggcgggtcaatctctggcgacttatggtttccaattgaaaatcagcatcaacagcaggaggcatccggagctttttttcagcccaagcgtgaaactgagcgagaccaaactcgtattcgggaaaaaccaaataggggtgcaggggcaaattcttagcggattgagcaagggtggggtgtacagaaggcatgaggacttcagcgacctctcaagacctatacgcatcgctgcgcttaaattgtgcgactaccctgcgaattcatttctgcaagagacccggcaacgcctcaaacggtacggttttgagactctgctgcccgtcgagaataagaaaaccctgctggtagacgatctgagcggggtcgaagcacgcgcgaaagccgaggaagccgttgacgaactgatggtgaaccaccccgacatcgtgctcactttcttgccgaccagtgataggcacagcgacaacacggaaggcggctcattgtatagttggatttattcccgactgctgcggcgagggattgcttcacaggttatctacgaggacacgcttaagagtgtggaggcgaaatatctccttaaccaggtgatccccggaatattggcaaaactcggcaacctgccgttcgtacttgcggagcccctgggaatcgctgactacttcataggcctggacatctccaggtcagcaaagaaacgggggtctggaaccatgaatgcctgtgccagcgttaggctgtatggtaggaagggcgaatttatcaggtacaggcttgaggacgcactgatcgaaggggaggaaatacctcagcgcattctggagagttttctgccagccgctcaactgaagggcaaggtagtgctcatttacagggacggccgattctgtggtgacgaggtccagcacttgaaagagagagcaaaggctataggaagcgagttcatcctggttgaatgctacaagagtgggattccacgactgtataactgggaagaagaagtcataaaggcaccaactctgggactggcccttaggttgagtgcgagagaagtgattctggtgacaaccgagctgaacagcgcaaaaatcggtcttcctttgcctctgcgactcagaattcacgaagccggtcaccaagtatctctcgagtctttggtagaagccacactgaagttgaccctcctccaccacggcagcctgaacgaaccgcggctgcctataccactgtttggttccgatcgaatggcctaccggagactccagggcatatatcccggattgttggagggggatcggcagttctggctt

SEQ ID NO: 213 - DNA, 2175 bp, Artificial Sequence
  Description of Artificial Sequence: Synthetic polynucleotide
atgaacctgactctgttcaacgagatcctccccatcaacatcagccaactgcccaaccagtacttctacaagctgtgcactgccggcgacgtggacctggattctctgggcaggagcatcaagtaccggatccagaaatacttcagaggaatctgggtgtggagtaccaacgaccaactcctcatttcagacaagctcatcgagtaccccgaactgcaaaagttcacccagtatctgtggaccgaccagtctaacctcacattcaaccagctcgaggggatagaaatcgagaacattaggtgttgcaccccccaaggcatcgctgatttctgtagccaaggtctcatcaaaaagtacgaccagcagatcaagaagatactcgaacagtccaagacagcacggagagactatcatatcaaactgatccacaagttcggctcctgggtggtgaacaatcagccctgcataagcctgagcctgaaacaggagatcgattttaacggaactctccaggactacctgaccaagttccccaactctaacatcatcggcctgcatgtgctcgacatcactaagcctttcaacaccgcacaggaggtcatcaagattctcggtatcttgggtgagggaaatcggcggcagcgcctcctgacttgggtcaaggagccaaccatgaaaaaactcgtggaagaggccccagatagtgagctcgtagttgagatcgggaacaagaaaaaatcctatcattacatcatttctgccctgcgcatcagagtcctcaaccaagattacctgaggctggggattagcgagaagctgcaaatagtcagtgaagagaggttgaagtacatcgagccacttttccgcatactgcaatcagagggcttcctggacaaggtgtatactagccagcgcaaccccgagctgtttaggtcatgcagcgaggaatggggttacaatcccctgctgaagttcaagaataacgccactgttgcggcggaatccgtgcagtccacggtccaggtggtgcagaaacacggcgaattcaggaaagccgacaaaagcgaaattaggatcgccatactcaacacactgaagagtgaaaacagcaccaaattgattgagattttccgaaacaactttaagcgaagctttaaccagaatttggagggaatcggtaatcagcttaagtataaactcaagttggtgggccagcccattgcactggatctcagtaagaactccctcagcctgctggacagcaaaataggagaattgtctaaaaagaagccggacattgtgatctgtgtgatccctaacttccttagcaagggcgaagacgggcggacactttacgacgatttgaagcagacgttcctcaaatacaatctccaatcacaaatgttgcaggagaagactctcacgacgtcatttgccacaaagaacatcgtgttgggcgtgctggcgaaaattggaagcgttccctatattctgcaagaaccgctgacgtacacggactttgtcgtaggtttggacgtgagcaggcgacgcaaaaaaaacctgcaaggaaccaacagcgtagccgccatgacccgaatctacagcaatcaaggcgaactggtccactatagcatccgagacgcaaccatcgacggcgagatcattcccaagaggatgctctacgacctctttccacttcacgaatatcagggcaaacgcgtggtgattcaccgggacggaaacttccccgaggaagagcgccaggcactcgaggaaattgccgaaaagattgacgcgaagttctacttcgtaagcattatcaaatctggcaatcccaggatctacggtaggaccaaaaacgaagagggcatcggcagttatcgcaaggcacctaagggtagcattttcctcctcagcgagacggaggccttgcttatcagcagcgactttccggaccgcttcagggccacgccacagcctctcagaattaagacgtttggcaactttccccttcaaagcgccgtccatagcgttctgtcactcacctacctgcactacggttccgagcgcccaccgaggctgccggtgtctacctactacgcagatagcattagcactatggtatccaagggcattaagcccaaggacgttgacggcaatatacccttttggctg

SEQ ID NO: 214 - DNA, 2247 bp, Artificial Sequence
  Description of Artificial Sequence: Synthetic polynucleotide
atgctccttaatcatctcccaatcgagttctccagcgcacagttcgctggacacgaaattgcttatgtcgacggcgagcagttgaggtccatacgacagagactcacgcgcacgcacttcgtgttgagggatggggacaatgttctgctcttcccgtacgaacatggaaccgcgaccgagggaaccaggcgaacattcgacacgggcgttaatttcagcgtagccaacgccctggcgcgcaacggcatgcttctgcgattcttccagcactctagaagtatttccggcgtccgaccggtgaaatttgtgaaagacaaccagaacctgctcacgggtgacgtaggccggttgtttgctatatgtccggagtacagtttcgacatccgacccctggcacctcaagacggcagccttgtgaacggggtactggtaaacttctcagcccgatttttggtgaagccctccctcgacgaattgattgcgcaggggctcgacccacggggcctgtatgttgttaaagaggcagaaagagaatcaccctacatcctgccgatgtttaatcggagattggtagggcggatccaggacgtggtcggaggtatcgccaagctggtggacgagcgcgaacaggacctccctgtacatgaacttcatgtcgaggccaacctggtcaacttcgagaaagtaggcagagcactgcttggccgggattacgagcgagtgagtcgacaagtgcttcccaccctccataaggtgagcggcgcagagaaacagctcgatcgcttggtccagctgctgacgagcttcaaagacctccagggtgacatcccgtgttgcgacggcctgaccgttagactggcaggcatacttacagatgtgcccttcggcagtgaggtgggccaattccgcaaattgtccgcgccacagtgcagcctccgcccagggggaactattacggtgccgtggcccgtggacggcaaactcaatgccaacggcccctttgatgcagacgccttcagcaggaaggaaccaacaatcggcgttctgtttccggagcagcacaagggtagtgtagaagagctggccgctaaactcagagacggcgcaccgagcgatggaaagtacccaagtccatttccccaaggaatgccccggaagtatagacttaggaagatgacatatgagctgacgcccacgaaagtttcaggggacagggccgcagcctacaagaatgccgcgcttgcagccgcccaacaagagcttgatctcgctctggtggtcatatctgaatcagataaggcgttgcttggagccgccagcccctactacactgcgaaagccacattgatgagccaaggcgtgccggtgcaggctattaccattgagactatcaacaggctcaacccctacaccttgaataatctggcactttccctttacgcaaaactcggcgggataccttggaccctgtcagttcaacagcgactggtccacgagataattgtagggatagggtctgcgagagtgggcttcgaccgcctctcagagcgggagaggcttgtcggcatcacgaccgtgttctccggggacggatcataccttcttggcaatgcaacgacggaagccagcagtaccgaatataggtctcgccttctggagagccttagggcgactttggcagagttgcgaagacgatttggctggcagcggggagataaattgaggattatcttccaccaaagctataagcggtacaaggagaccgaagcaaccgccgttagcgacctcatcgccgaacttgatgaattcgatgtggaattcgcgtttgtgcagatcagtagcgatcatgactggaagttgttcgatgagagtgccacaggcgttacgtatcagtcccggcaaaagggagcgaaggtgccggaacgcggagtcatagtccctctcggacctcgcgctgcgctgatcacgttggtgggtccgcatcaactgaaaaccgacctgcaagggtgcccctcccccatactggtgtctatccacccgagctcaactttcaaggatttgagttacgtgtcaaagcaggtgttcgacttgacctttatgagttggcgaagctttaacccaagcacgcagcccgtttccgtgagttatcccaacatggtggtggatctgctcggtaacctgcggcaaatccccaacttcaatcccgacattctgacgacaaaactgagggagtctaggtggtttctg

SEQ ID NO: 215 - DNA, 2127 bp, Artificial Sequence
  Description of Artificial Sequence: Synthetic polynucleotide
ttggacaattacatactgaccgagtacaaggccggcatccacgccagcgagatcaagatacacatctaccggatgcccgtcaaggatcttgagaaaatcgactatgagtacgggaagtacacacgcgacctcagacaaaaaaacaggaagacgatatccttttaccgctctctgatcggcagctttgagaagctcaccatcgtgcccaagggatacgagaagtacgagtatagatcaattaaactcgaccagagtgaggagtcactccaggagaggaaactgctggagaggctgatcttcgacggccttagggacagcaataggaaccactttatgagcaccgagcagagcatcatcgagaaagagcccatcaagtccctgagcaagtgcaaaatccaccggggtatctacatagacatcaccgtgaaagagaaaggcgacatcttcatcggtttcgagctgaagcactccatccagagcacccacacgattatcaaggctctgaaggagaagaaactgaacaagggcgataaggtgtttgactttctgaacagcgcccactacgagttcgaggggattagcgacaaaaccatcagcgacccccttcccgaactgggcaacaagagcattatccagcactacaaaacgaaacccagcatctactgccacctcgtgaaaaaaccgaacatgcccgccatcctggtacgcagcaagagcggcaaggtgtatccttaccccccacagctgcttaagaaggagtgcctgatgaaggatgtgccggctaaggagcacagctctatcaagctgaaccccaacgataagatcaactacagcattgagatcatgaagagaatcatagatgcgttcgagaacaggtatttccccatcggctttgaaaagaacaacctgaacatcgccaagctcggatacaggaggaggctggtcccggatcccctgctgaggattggcaacggagccacctgcaaccacagagacctcaagggtgccttccttaggcacaagatttatgacagcgtgagctcccctatctactaccagcttctgcttgaccaacccttcgaaagggagtggcagaaaaagatgagcgaagcgttcattacgaagatggaaaaccggagcaggcagtggggcataaagcttcagtgtaccgggaaccagatcctccctacctctaacccgtacgcgctgagactgcatcttaaggacatcaacctggataccgacatcattagcgtggtcctgttggacgagaccaaacaagaaggcgaggaggtttactctaccatcaaaaaagagctgggtggcaccaggggcgcacatacccaggtaatcctgatcgatagcctgaagaacgaatacactatcccccagatactgttgggaatctacaccaaggctggattgcagccctgggtcttgcaccagccgttgcacgccgactgctacgttggctacgacgtgagccatgaaaatggcaggcacaccactggcatagtgcaagtgttcggcaaagacgggtcacagatcttcagtcagcccattagcagcgcggaggccggagagaaggtgtcaaaggagaccattcagactatggtgatacacgttctttactattaccagaagaaagttggcaagatgccacagcacattgtcttccacagggacggccgaggatacgtagaggagatagactggattaaagacatattgagtaatagggacctcaccaacggccaaagcatcgctttcgattacatctcagtgatcaaagagtgtggtcggcgcatggcttactttgacgacataaagaagaagtatgtgaacgtgcccgggattgcctacctggacgacaacgcccaaaaggcctatctttgcagcaccaatccatacgaaaaagtagggatgagcaaacctattaagattgtgaagaagattggcgagatgaccctggagcagatcgtagaagacatctatcacctgagttttatgaatatcgacaccgataggaaggtgaggctgcccgtgactaccaattacgccgataagtcttcaacgtttttctctcgcggctatctgtcatcacaaaagaaaggaattggcttcgta

SEQ ID NO: 216 - DNA, 2253 bp, Artificial Sequence
  Description of Artificial Sequence: Synthetic polynucleotide
atggtcggcggctataaagtcagcaatttgacagtggaagcgttcgaaggtatcgggagtgtcaacccgatgctgttttaccaatacaaagtcaccggaaagggaaagtacgataatgtgtataagattatcaaaagcgcacggtacaagatgcattctaagaaccgattcaagcccgtgttcatcaaggacgacaaactgtacaccctcgagaagctcccggatatagaagacctggatttcgcaaacattaacttcgtgaaaagcgaggttctcagcatagaggataatatgtcaatttatggcgaggtggtggaatactatatcaatctcaagctgaaaaaagtgaaggtgttgggaaaataccccaagtacaggatcaattacagcaaagagattctcagtaatacgctgctgacacgagagctcaaagacgagtttaagaaatcaaataagggttttaacctgaaacggaagtttagaatttcccccgtggtgaataagatgggcaaagtgatactctatttgtcctgcagtgctgatttcagcaccaacaagaacatttacgaaatgttgaaagagggcttggaggttgaggggctggccgttaagagcgagtggagcaatatcagtggcaacctggtgatcgagagcgtactggaaaccaagatatccgagcccactagcctgggccaatccctgatagactactataagaataacaaccagggctatagggtgaaggatttcaccgatgaggatctgaatgccaacattgtcaacgtgagaggaaataagaagatctatatgtatattccgcacgcgttgaagccgataatcacccgggagtacctggccaagaacgatccagagttttctaaggagatcgagcagcttatcaagatgaatatgaactaccgatatgaaaccctcaagtcatttgtgaatgacatcggggtcattgaagagctgaacaacctgagcttcaaaaacaaatactacgaagatgtgaaactgctgggttactccagcggcaaaatagacgaacccgtcctgatgggggcaaaagggatcataaagaacaaaatgcagattttttccaatggattctacaaactccccgaaggcaaggtacgatttggcgttctgtacccaaaagaatttgatggcgtgtcaaggaaagctatccgcgccatttatgacttcagtaaggagggcaaataccacggcgaaagcaacaagtatatcgcggaacacctgataaacgtggagttcaatccaaaggagtgcatatttgagggatacgaactgggcgatatcaccgaatacaagaaggcggctctgaaacttaataactacaacaatgtcgacttcgtaatcgcaatagtcccgaacatgtccgacgaagagatagagaacagctacaatccgttcaagaaaatatgggccgaactgaatctgcccagccagatgattagcgtcaagacggccgaaatctttgccaatagcagggataacacggcgctttactacctgcataacatcgtcctcggtatcctgggtaagataggagggattccctgggtggttaaagacatgaagggcgacgtggattgcttcgttggactcgatgtcggcaccagggagaagggcatacattaccccgcctgcagcgttgtgtttgacaagtacggcaagcttattaactattacaagcctaacatcccgcagaacggagagaagattaacacagaaatacttcaggaaattttcgacaaggtgctcataagctatgaggaggagaatggagcctacccgaagaatatcgtgatccacagggacggctttagccgagaggaccttgactggtatgagaactacttcggtaagaaaaacataaagtttaacatcatcgaagtcaaaaagtcaactccgttgaaaatcgccagtataaacgagggaaatatcacgaatcctgaaaagggttcctacatcctgcgcggcaacaaagcctacatggtgaccacagatattaaggaaaacctgggaagcccaaagcccctgaagatagaaaagagctacggcgacatagacatgctcacagctctcagccaaatatacgcactcacgcaaatccatgtgggggcgaccaaaagcctgcgcctcccaatcaccaccggctacgccgacaagatttgcaaggcgatcgagttcatcccccaagggcgcgtggacaaccgccttttctttctg

SEQ ID NO: 217 - DNA, 1872 bp, Artificial Sequence
  Description of Artificial Sequence: Synthetic polynucleotide
atggaccgcgagatcattgaaaacttcaaccccagcgaccccaggaccgagggcgagaagtatctgatggataacttttcaacctcccccaggtttaatggctggacaatatttgagcagccccacatcaactcaatgaagcccgacttcatcttgctgcacccccacaagggcatcataatcatagaagtgaaggactggaacctcagcagcgagacatatgagaacggcggttacatctggggggaaaacggcgagaggattaagaaaaaccccatcaatcaagtagaaaactacaaaaactctatactcaagatggaacttacaaacagcatcgaatttagtgaagtgttcggcgacaaatacttcgcgtgcatagaaacggtggtatactttcacaaagccaacaaaattcaagccgagaacttctgcaggaggaacaataactacaccaagatctggaccaaggacgagttcgactacatatgcaatatcaataacaaactgaagggcagttgtcacacctatgccctgagctacgaaaaaagcacccttgaagacaacagaggtatgctgagtaaactggtggaggagctcaagtgcaatctccagtacagtgactacaactatgaacgacgccaaccgattaagttgacctatgagcaagagaagttggcgaggctgcaaaagaattcaatcaggaggtggagcggcgtggcaggcgctggcaagtccctgagtctggcgcaaaaagccgtgaacgccctgaaggaggaccatagcgttctgatcctgacctacaacataaccctgaggcactacctgcgcgatctgtgctctcaacagttcggacccggctcctacaaaggcgagcgcaagaagctgaggagcgacctgaccatctgtcactttcatgactttttgagaatcatcatggccgagtacgagatcgaggtcgaacatgacgaagacgacaacttcacccagcactggataaacaagatcgacagttgcataaaggtgaacggcatcaagagccacctcaagtacgactatatcctgatcgacgagggccaagactttgaaggcgaatggattaggttcctgaagcagttcttcaccgaggtgggtgagatctttatcgtgtacgacaaggcccaggatctctacgagcatggcgtgtggatcgaagacagcaaccaaatcaaaaacatcggctttaagggcaagcccgggaacctgaaaatcagtatgaggatgcctgagaagatggtgtacctggtgcaggacatcagaaatgagttcaagatagatgaggaggagatcaccccaaacgtgaacagccagcagagcttcatcgagataaccaagtggattaactgtatgcccctgacgctcactgaaaagctcgaccagattgaaatacaggtggactttctgcgccgaaacaacaacagcctggaggatatcacgatcattacgaccaacgaggagaccggagtggagatagtgaataggttcaaaagcaggggtatcaagaccagccacgtctacgatatggagaagcgggggaaccaggccaggcgaaggatggaaaaatggaaattccagggcggcaccggcagactgaagatttgtagctatcacagctataagggctgggagactccgaacatcatccttgtgctggacgagccgagcacaaagtatgaagacggcataattagtaagggggagtataacgagaagaacattttcgacgctatcttcattagcatgtccagggtgaaaaggaaagcccaaaccggtgagtttagctttacgtgcctgaattatcttagcgaatacaataagattgagggcctcttccac

SEQ ID NO: 218 - DNA, 1998 bp, Artificial Sequence
  Description of Artificial Sequence: Synthetic polynucleotide
ctggggctgaataatgagtccaaagagttctttaagggcattagccgcatttggagaaattacaaggactacacctaccttgacgggattaagctgagccaggcgcagatcgatatcatcgagaaggaggaagaccaattgcttatagagggctacgccggcaccggtaagtccctgacccttatatacaagttcattaacgtgctggttcgggaagatgggaagagggtgctgtatgtgacttttaacgatacgctgatcgaggatacgaaaaaacgccttagttattgcaacgagtacaacgagaataaagagaggcaccacgtagagatttgcacattccatgagatcgccagtaatatcctgaaaaaaaagaagatcatagacaggggtattgagaaactgacggctaaaaagatagaagattacaaaggtgccgctctccgcagaattgcgggaatcctggctaggtacatcgaggggggaaagtattatagcgagttgcctaaagaggaacgcctctacaagacacatgacgagaactttatcagggaggaggtggcctggatcaaggccatgggctttatagaaaaggagaagtatttcgagaaagatcgcattgggaggtccaagagtatcaggctgacgcgctcacaacgcaaaactatattcaagatatttgaaaagtactgcgaagagcaagaaaacaaattcttcaaaagcctcgacttggaggattacgccctgaagctcatccagaacatagataatttcgatgaccttaagttcgactacatttttgtggacgaggtacaggatctcgatcccatgcaaattaaggcgctgtgtctgctgaccaatacgagcatcgtgctgtcaggcgacgcgaatcagcggatttacaagaaatctcccgtgaagtacgaggagctcggcctcagaatcaaagagaaggggaaacggaaaattctgaacaagaactatcggtccacgggtgagattgtcaagctcgcgaactcaatcaagttcttcgacgagtccatcaataagtataatgaaaagcagttcgtaaaatccggtgatcgcccgatcatccggaaggtgaacgacaaaaagggtgcggtgaagttcctgatcggcgagatcaaaaaaatccacgaagaggacccctacaaaacaatcgccatcatccaccgagagaaaaacgagcttatcggcttccaaaagtccgagttccgaaagtacctggaaggccagctgtacatggaaaaattcagtgacatcaagtcctttgagtcaaagtttgatttgagggaaaagaaccaggtgttctacaccaacggctacgatgtaaaggggctggaatttgatgtggtgttcatcataaacttcaacacggccaactacccactgagtaaagagctgaagaaaatcaaggacgaaaacgacggcaaggaaatgacgctcattaaagacgatgtgctcgagtttatcaatcgcgagaagaggctgctgtacgtagctatgaccagggccaaagaaaagctgtatctcgtggccgactgcaaaaacagcaacatcagcagcttcatctacgactttaacaccaagtactatgaggcacaaaatttcaagaagaaagagatagaggagaactacaaccggtacaagattaacatggagcgcgaatacggcatcatcattgaggacgacgactccaacaacgttaagaacaatgacacgaaacaagagaacaagtttaataccgaatctaaggaaaagggcaaagatgacatcgacaagataaaggtgtttttcatcaacaagggaatcgaggtggtggacaaccgagataagagcgggtgcttgtggatcgtcgccgggaaggaagcgatccctcttatgaagaagttcggtgtcctgggctataacttcatattcatcgcaaacggcggtcgggcatctaagaaccggccagcctggtacctcaagaatagc

SEQ ID NO: 219 - DNA, 3126 bp, Artificial Sequence
  Description of Artificial Sequence: Synthetic polynucleotide
atgaacaacaccataaacaaaatagacttcggcgcgtttctgagatcattcaagcagaacctggacggtagcttttctttccttctgggagcaggcgcgagtgtgagcagcggcgtacagtctgcaagcgactgcatttgggactggaaaaaagacatttttctggcccaaaaccttcaatttgaggagtttctggacatccatagtgacttctgtaaagataaaatccaaaagtggttggatgagcagggcgtgtttcccaagcgagactcagaggaagagtacgtgttttatgccgagaaagcgtacccaatggaacaggacaggaccaagtatttcgagaacctttgcgcggacaaaaccccctacatagggtataaactgctgatgctgctgaacaaatacggagttctgaaatccgtgtggacaacgaattttgacggtctgatagaacgcgcagcgcaccaagccgatctgacgcccatcgccgttaccctcgacaaccccgaaaggattagccgaaacgagagtaaatctgagctgctctacgtggcactccacggtgactacaagtatagcaagctgaagaacacagcccaagagctggacgcgcaagaaattctcttcaccgaacgcctgaagtcttacttcatcgataagaatttggtggtgatcggttacagcggtcgagacaaaagtttgatgcacaccttgtgcgaggcttttatgacgaaggggtgcggtcggctttactggtgcggctacggtaacaagattacctctgaagtgcagaacttcctcaacagaataaacgattcaggtagggaagccgtgtacgtggacaccgatgggttcgatgccaccctcgtgtctattatgaagttttgctacgaggatcaattcgacaagaaaatcgaaatcggcaagtatctcaagggcctgtcaagggtgaagcatattatccctttcagcgttgagaataccacgttcaccggctgcgccaagaccaacctgtaccccttgatcatcccccaagacatattccagttcgagatagagagccccgaaggtagcagcaaatggaccttcattaaagagaagattaagggcaaggacattatcgctgccccttacgagaaaatagtctacgcatacgggctgccaaactcaatctacaacgtattcagtaaggagctgatcggcgagatcaagagggttcccatcagcctgagtaacatcaaagacaacagcaccctcaagaatatcatcctgaaggtgctgatatgttctctgagcagtaacgcgggactcagggcgagtatgagcaagaagatcatctggaatgagaaagagaggttccagagcaacgtttttaaggcaataaagatcgacatcgttttcatcaatagcgaaaagtacgccctcatctcaatcacccctaccctctatttcaacaaggagggcaactacacgacgctgcagaagcaggaaattacgcggagctacattgacaagctgtacaataagatttatgaggaaaccctttgttactgggaggccatcctgtttaagcagcagaccaagatctgcttcgactacccgctcaattccgggaacggctgtttcttcaaggttagctctaacaggggcgaagccctgttcaataatccgaataagccgtacgtgattactaacgacatcatacttaaacgcaaaatctacgaaggcatcataatcgacgagcccctcctgaacttctcagggtcaaccagcgcccacatcattatggactccaatccgatgcgcggtctcaacaacaataacccatatgatcacttcattgcaagcaagtttagggacgtttctatccacatcggagtcgtgtgtccctgtacatatagcgacaggttttttagctttctgaacgagctgcaaagtccgataaagaataacaatcctaactcagactacatccagaactataacggattcagccagatatacgcaagcattcttaatatcccagcgatcaacagccaatactggatctcatgccgcgaagagcaggataacagcatctctttggctaggaacctgtgtaaatacgcgaaccagatggccactaacatgccaggtataatagttaccttcttcattcctaacagctggagcaaccacaagagtttcaaagaatgtggcgaggtattcgacctccacagttacatcaaggctttcgccgcacagcacggttttacaacccaaatcattgaagagcgaactctcacaaatctctccatgaaaaaggagatctattggtggctgagcctggcgttctttgtaaaggctatgcgagtaccatggaccctggccaatctggaccagaacaccgccttcgccggcatcggctactccctgagcaaaaagcaaagcggcaaattcaatatcgttatcggctgtagccatatctataattctgagggccaaggcctgaggtacaagctctcaaagatagataatccaatcttggaccggaaaaacaacccgtacctgacctataatgaggcgtataagttgggcgtgaacatacagaatctgttcattcagagcatggacaaactcccgaagcgagtagtgatccacaaaaggatcccgttcctggaggacgagataaagggcattaccgaggcgttggcccaggccaacatcacgaatgttgacctcatcactatcacgatcgaaaagaacatcagatgcctggatcagttcttctacaatggtcaagccaagaacagcaacttcccactgcataggggcacctgcatgaagctcagtgataccgagtgtctgttgtggacccacggcgtggtggactcaattaaggcgggcaggaactactactctggtggcaagggtatcccctcccccctccgcatatcaaagttttacggcgcaggctctatgaagactatatgcaacgaaatcctggggttcacaaagatgaattggaatagctttaacttctataccaagcttcccgcgaccatcgacaccagcaacacgctggcgcaagtggggaacatgctcgataattacaacggtattacatacgattacaggtatttcatc

SEQ ID NO: 220 - DNA, 2901 bp, Artificial Sequence
  Description of Artificial Sequence: Synthetic polynucleotide
atgatgggagccagcgatgagtattccttttacgctgaaaaggcctatcccatagaagcggacaggcaaaagtacttcgaacagctggcgtacaacaaagccccctacattggctataaactcttgtgtctgctgaataacgcggggctgataaagtctgtttggaccacaaattttgatggcctgacggaaagggccgctcaccaaatgaacatcacccccatctgcattaccctggacgaccccgagaggatttttaggaatgagaactctcacgaactgctgtatatcgcccttcacggcgattacaaatatagcaagctcaaaaataccacccacgagctggacacccaaaacaatatcttcagagacgcactgaagcgatacttcgtggataagaatcttattgtcataggatacagcggccgagataaaagcctgatgaacgcacttaaagaggcattttcccaatccggctccgggcgactgtactggtgtggcttcggggacgatatatgcagcgacgttaaggaattgatagacatcgccaggagcaataatcggattgcctacttcatcccgacggacggcttcgataagaccatgctccaacttagtcgcgcctgtttcgaggacgacattgtgaagcaggaggaaatcaaaaagctgatcaagtccacgatcaagaaggacgagacgaagaccagcttccgaatcgagagcagcaggaacgataaacttattaagtctaacctgcatcccgtggcgttccccaaggacgtgtaccagttcgagattaagactaacggcgagcatctgtggaacaacatagaccagatcattggcggcaataaggacatagttgccgtaccgttcaaaggtaaggtgttcgctgtctcaagcattgcgaaaatcaaggagaggttcgggggctatatcaagggggaaatattgaaagacccgattggcgtcgatgacatccgcaaagtatctgtgttccagcggcttatgatgaagagcatcctgattggaatctctgagttggcaaatctggaaactgatggaaagtggcgcctttggaaaaagaacaccctgaggcgaatcgtaaacggcacggagtatttcatcgccgacgctgtagagctgtcctttttcttcggaaaagataccaagtttgcctatctcagcatcaaaccgaccatttacatttatacacatagcgacgaattcataccgaaggatataaagctgcaattcacaaaggagaagttcgaccgactctataatgcacaatacgaccaatccctggaggagtggaataatctcatcttccacaacaacagcctgaggttcacctttcccgtactgaccacctccgacatgagctttagcatcagcaacaatgtggccttctcaggaattaaggttttgagtgacaagtataagagctaccccgtttctatcgagcagaagcgcatagttttcaagggcgtggagttcctggagccccagctgctgtttcaaaataagaacagcaacttcaagtcacgcgacttccatcccatgaggggattgattaaccactaccccttcgactaccagaacaatgggatcaccaacacgtttaatgtcaaactcggcgtgttgtgctcctctaagtactctactaggctgtacgagtttctcatgaaattgaatgcccaacataaagcgcccgagaaaaacgagtacataattgactatgctggattcaaccaaatctacaacatccctattgagataccgctggtaaacgacgagaagtggatggacgtaaagtttaatagcagcgtgagtatcaaagacgacgctctcaacctggcaagaatcatatgcacccagatcgaggcgcttcacgagtcttacaaaactgacatgaccatcgtgatcttcattcccaacgagtggcaaccctacagacatatcgaggaggacacatgggtttttgacctccacgactacatcaaagcatatagcgctcagaaaagaatttccacgcagttcatagaggaagatactctgaacgattcattgacgtgccagatatattggtggctcagccttagtttttacgtgaaatccttgcggacgccgtgggttctgaatgctaacaataatgagaccgcttacgcgggcatcggctacagtataaagaataacaacggtgaggcgtcaattgtcctcgggtgtagccatatttacgacagccacggccagggcctcaagtacaaattgagcagagtgcaggactgctacatcgacaacaagcggaacccctacctgagctacaatgaggcctacaactttggcataagtatcagggagctctttctgcacagcatggagtacctgccaaaaagggtagtagtgcataaacgcaccgagttcaaacccgacgaagtgaatggcattgtcgactcactgcagatagcgggtatcgagaatatagaccttatctccatcaacttcgagcgggaagttaaattcatgtccactaaatccaactacgggcagttgcaaatcgataactttcccatacgcaggggcacctgtatcgtggtgaacgactatgaagcccttctctggacccatggaattgtgccgagcgttaagtccgataacaggaccttctatctgggcggacgatctattcctagccctcttatcattaagaagcattacggtaagagcgatatcaacgttatcgctacagagatactgggtcttaccaagatgaattggaactcttttgatctctacacgaagctgccggccaccatcgatagctctaatcaaatcgcgcggatcgggaacctgctgactaggttcgagggcaagacctatgattaccggtttttcatt

SEQ ID NO: 221 - DNA, 2466 bp, Artificial Sequence
  Description of Artificial Sequence: Synthetic polynucleotide
atgcgattggggcacataggcaacggctgttacagggaaggcgttaaagcacaattccagacacgagagagggaggatgccggttcaagggctgcggctgcccaacccccgattaagcaattcggatacaccgatagactcggcctgaacctcgcccccataaggttttctagcgaagagtttgaagccggacggacggtgtaccgcgacgaggaacagtaccgagctcttagggaagcccatcaagccacccatgcctttaggtatgacgcaagggacgcggctatatacgacatccctatggcagaaggggtggcgcctctgggtactcccgtgaggatcaaaactaaggaccacctcgctctgctcggcaaagcggctaaccacgcgctgctcgattggctcgcaccacgcagaaccattctgcggagggcgagacctcttcagtgctggggcaacaggaaggcctcactgttgtcagccgccgtgcgggatcaaggacttgccgaaacaaagggtctggatgttctggtaaggcattcttttgatttgagggctttgggcgcacctcaccagggtgctgaaccgtaccttgccctgatgttggacgtgagtacgagcaatgagctggagatacctgtgggcgagcttctgcgcgagagattcgaccccatcggtcgatacgtttgtgccagagccgactctggccaagataacgtacttgctaggttggaaacactgggtagggtcgtgggtgtggatggtggtaagcttcaactgaacgactttaccggagaagaattcgtggacgctgattcagtcacgttggagcctagattggagaatctcgatgcgctcattcgccacttctatcccagggatgcgccaaaaatcctggagggccttcgcaaaaggagagtgcctttctccaccgcgaacgacaagctggcgaagatacgagaagtgcacggaggagtagccggccaccttgaaacgattaggatcgctggcatggctatagaggtgggtgccctgctgcagagaggctctaacctgtttcccccactcataagcacggaccggcctggatttctgttcggcgctcaaggtagggaaactggcgcgttccccgacgtgggggtgaagcagcatgggccctacaagtacatgcaacacgagcgcaatgaacctgtgatcgccatcatctgcgagagcaggtttcggggtcggatagaccaactcgcccgaacacttcgcgatggtgtcgcggaagatgcctggcaagacgcgatgaggggcagaaataaggtgccggaaaacccctttagaggcgggctgatcggtaaattgagattgtctcgggtgcagtttgagttcgaagaagtaaccgagcccactcccgaagcctatcgcgaggccatccttcggctgcttgcgagactcccagagacacccgacctcgcgttggttcaaatacgagcggattttaagcagctccgcaacgacaggaacccatacttcgctgcaaaggccgcattcatgacggtgggagtgcccgtgcagtccgtacaagccgagactgcggacatgcagcccagtaatttggcctacatggccaacaacctggccctcgccgcctacgcaaaattgggcggtagtccgttcgtgatctccacacgcatgccggcgacgcatgagctcgtggttggcttgggctacacagaggtgtcagaaggacgctttggaccgaagtcccgatttgtaggcatcaccaccgtgttccaaggcgatggcaggtacttggtgtgggggcaaactagagaagtagaatttgaaaactacgccgacgctctcttggcgagtctgaagactaccatcgacacagtgcgcaaggacaataactggcagccacgcgatcgagtgaggttggtattccacgtgtataagccccttaaacatgtcgagatcgacgctatcaaacagttggtgcaggagttgctgaagggcgaacatgaagtggagttcgcatttctggacatctcccgcttccacgattttgcccttttcgatccttcccaagagggcgtgaattactacgctgaccgcagacgactgctgaaaggcgtgggcgtcccccttaggggtatctgcctccaactggacgaaaggagcgtgctcttgcagctgacaggcgctaaggaggtgaagaccagtgaacaaggtctgcccaggcccctgcgactgacgttgcattccgagagtgattttagggacctcacatacttggcgcgacaggtgtacagctttagctacctctcctggcgcagctacttcccggccatagagccggtgagcattacctacagcagacttattgccaatgcacttggcaaccttaagagcatcccgaactggaacagcacattcttgacagctggcccactgaggtcaaggatgtggtttctg

SEQ ID NO: 222 - DNA, 2025 bp, Artificial Sequence
  Description of Artificial Sequence: Synthetic polynucleotide
ctggagaacctcaccataaacataatccccttcaagcaccccagcatccaaaaagaatttggcttctataccgagaagaaggagggctatttccccattcataggaccgagttgcccaacgagctgtgggacaaccagaaagaggaagtggtgaagcacaagttctactacacgaactttgaagacacggaggattgcgttctgaagaccaaggtggacctgtatagtagcactaagtttgccaagcatctgtacacgcgattggtgtaccagtatttcattgggatagcggatgcaatccagttcaactacgtgggtgacatagaggtttggctgctggatgcgaaagccagcaccaccaaatacaatagctacaacaagtataccctgaaaatagagtttagcggtctgaccaagagccccgctctcctcctcagctatgacaacactagtaaggtagcgactacgagcatagacgaaatcaacattcccaccgagtacttcaagaccgtcgtgtataacaaagaaatccagaggttcaagtacctgaccgaggacgcgaaacaacacctcgatcaagtgtatcccctgctcaacataccgttgaaaaaccatcttgagattcctcacaccgttccccgcaagggcaacaggtataagccctactttaaccacattacgactttttacaataactatttgaacaccgacgaattcagggccatcctgccccttgatgagaatggattcttcaatatcccagaggacagcattttgaaaactagcaaaaattctaacaacctccggttctataagaaagtcggagtagatcccaaggctggaatgaagaagcccggtccctacaaggcctccccccacgacaacgtgaacctgttctttatctatcacaaacccgacgcacatgaatacgccaaaacgttgcatgactacttcatggaggggtacaaaaagttctttccccccctcaagaacgttatccggcagccgctgttcctggacaaaggcacctcacttgcatttgagagcttcgacagctgcatcgccgagctgaaaacccatctgttcgacctcaaaaaaaagcccaatacccggtacgtggccatctacgtgagccccatccataaggaggacgaagacaataaacacctgtactaccaggtcaaagaagagctgcttaaacatgacatcaccagccaggtgatttacaaagagtccatcaaagataaatacttcggcgctttcctcgagaatatcgcaccagctttgcttgcaaagatcgacggcattccctggcgactggacagggagttgaaacaggaactgatcgtaggcgtcggcgcctataaaagcagcgtcaccaacacaaggttcgttggaagcgccttttgctttaacaacaaaggagagttcaagagctttgactgcttcagggagaaggaattcgatctgattgccgggaaaatcggcaagcaggtgctcaccttcattgaggagaacgagaacaagttggagaggctgatcatccattatttcaagcctttcaacaaggatgagatagatctcgtgcaggagaccctcggcctgctgaagctggaaatccccatcatcatcgtgactatcaataagaccgagagctccgattacgtcgcttttgacaccaacgacgacgccctgatgcccctgagcggcaccattatcgagatagcacatctgaagtatctgctgttcaataacgcgaagtacagcagcatcggcttcgccaaagaccaccccttccccgttaagctcagtctgtactgcaccgaccaggattacttcgaggacatcgccatcgtcaaggagctcatagatcaggtttatcagttttctaggatgtactggaagagcgtcaagcagcaaaacctgcccgtgacaatcaaataccccgagatggtggcccaaatcttcccacactttgagggcgataaactgcctgattttggaaaaaacaatctctggtttctg

SEQ ID NO: 223 - DNA, 1323 bp, Artificial Sequence
  Description of Artificial Sequence: Synthetic polynucleotide
atgctgaccaataatcagattgtgctggagcaggaacttctgggaagcatattcaaaaacaataacctgatgctgaaagcccgagagaagataaaaccggagatgttcctgtatagcaaacacatgaacatttacctgggcatcctcgacatggtggccaacaagctggaggtggacctgatcacctttctcgagcaccataagaaaagggtgggggatatggatggcgtaacttacgtgaccgagatctacacctgcagcgcgtccgacattggcttcaatacaaaacttgacatgctggtgaacaactacaaacggcatctgtatgtggagatgaaggacaaaatcaacagtgatatgagtcttgaggagatcgagagcgaggttgaaggggtgaaggtaaaggtgcacaaatgcaacatcaagaaagaactggatatagacaagcaatatgacgattacatcaactggctttacgacgaaaacagagacaaggggatgaaaagcggcctgacctatctggacaagtatctcggcaacttccagaagggcaggctcgtcaccgtgttcgccaggagcggcgtcggcaagaccacgttcagcttgcagctggccgccaatatggctctgaagggccacaagatattctacgggagcgcagagatgacccgcaaccaggtctttaacaggatcgtggcctcaggtttgagccttagcgcgaaggcgattgatgaggacaccatcctgaaggaggacaaggagagcatcgccaagtttatgaccaaggttatcaacaacaagttctacgtgtcaaccgagaccgacttcgaaaagttcatcgacgagataaaggtttataagctgcagaacagtctggacgtggtgttcgtggactacattaacaagtacatcgacttcaccgacagggacatgttgaccaacaaactggggaagatcagcggcatgctcaagagcctggccatggaagaggatatctgcgtggtgctgatggcccaggccaatagagtgattgacaagaaggtgggtgacaatgccgtcgaaaaaatcgacagcagcgacatccaggacagcgccagaatcgagcaagacagcgaccaagtgatcggcctgtaccggaacgtgaagctcgatgataaaatgtatagggagaacctgttcaatcagggcaagctcaagtataattccaagaacgccgacgacaatccggaatgcatgaacgctgtgatcattaagaacaggcatggcgaccgaggcacgtgtgcactgaggtggcacggcaggtacagcagggtcagcgacttc

SEQ ID NO: 224 - DNA, 2268 bp, Artificial Sequence
  Description of Artificial Sequence: Synthetic polynucleotide
cttcaccttaactacctcccattgcgctttaccgccgatatattcaagggtggtgctttgacatttcccgaaggcagcgagaaaaactggaccagcgacgatccaatcagcaaggagctgagcaagttgcgagagaaacacggagatagtcatgtcttccaccggatgggaaacaaaattgcatgtatccccgttgtggagaacgccattgctataggcaccgagacggatttcaacatcattagtgactttcagctggctaatgctcttgctcgcagcgccctccacaggtacttcaaagctgcgggaagggagactgtaattgggttccgacccgtaacccttctcttggaaaaacacaacttggccagcaacaggaaggacgtgttcggcattttccccgagtacactctggacgtcaggcctcttgcaccacatgagggcgacatagcgagcggagtgcttatcggctttggaataaagtatgttttccttcagaacgtagccgagctgcaggcacaaggggtgagtgccgcagggatgtacgccgtgaggctggtagacgagagcgaacatcaatttgaccgggcctacctgggaaggattgatcggttcacaaaagataacgtgacgctcgttgacagcgattacgcggaatatcccgccgaccagtgttacttcgagggaagcaggaccaacatcgaagccgtgggccgaagtctcctggggaaagactatgatgccttcagctcaagccttttgcaggagagctacaaagtgaccggagcccccaaccaaacccaacgactgcaccagttgggcgcgtggctcgaggccaagagtccgatcccctgcgccgttggtctgggagtacggattgcaaaaaagccgcatgagtgctcacgaggcaacgacgccgggtacagccgctttttcgacagccccaagtgcgtgctgcggcctggcggctctctgaccgtgccctggccggtcgacaagcagatagatctcaatggcccttacgacgctgagagctttcccaacaagagggtacgaattgccgtcatctgccctcaggaattcaccggggatgcggaagagttcctccggaagttgaaggagggccttcctaacgcaccggacggcagtccgtttcgcaagggctttgttcgaaagtaccatttgtctagctgtgacttcacgttccatgaggttaagcggagctcaaacagtgacgacatctacaaggatgcgtcccttgaggcactgaagcagaagccagatatggcaatcgccataatccggtcccaatatcgcgggctgcccgatgcttctaatccctattacacgacaaaagctaggctgatggcccagggcgtaccagttcaactgctgaacatagagaccatcaggaggaagtctttggactacattctgaataacatcggtcttgcgatgtatgccaaacttggaggaatcccttggaccctcacccagaatagcgacatggcgcacgagatcatcgtcgggatagggtcagcccggctcaatgagagcaggaggggtgctggcgagagggtcatcgggatcacgaccgtgttcagtggtgacggacagtacctcctcgccaacaacacccaggaagttcccagcgaagagtacgtagacgcattgactcagtctcttagcgagacagtatcagagcttaggagccggttcggttggcgccctaaagatcgagtgaggttcatattccaccagaagtttaagaagtacaaagacgcagaggcggaggcggttgataggtttgcacgctcactgaaagattttgacgtgcaatacgccttcgtgcatgtgtctgattctcataactggatgctgctggacccagctagtcggggggtgaaattcggcgatacgatgaagggcgtcgccgtccctcagcggggacaatgtgtgcccctggggccaaacgctgcgctgcttactttgagcggtccgttccaggtaaagaccccactgcaaggctgtccgcaccccgtgctggtgtcaattcatgagaagagcacttttaagtctgttgattacatagcccgccaaatcttcaatctcagcttcatcagttggaggggctttaaccctagcaccctcccagtgtccatttcctactccgacatgatcgtagacctcttgggacatcttagacgcgttaagaattggaatccggaaaccctgtctaccgctcttaaggaacgaaggtggtttctg

SEQ ID NO: 225 - DNA, 2289 bp, Artificial Sequence
  Description of Artificial Sequence: Synthetic polynucleotide
atgcaactgaactatttccccatccagtttgacttttctgactaccaggtcatcacgcagccctactccgacgagagattgaaagaactcaggcaggcctacaacgccagctattccttctttcgggacggcaaccttatcgtaatttccaataaagaggacgaggaaaaccaattgacgggcaacgtcgaaaaccgcagcgtgttcgacgatgccaaagttaccgccagcatggtcaagcatatattctttaggacgttcaaggacaggttccaaggcttcatccccgtggacttttaccccttccgattctacagcagacaagagaaggacgaccttattctgaaccacctgcccgaaaaacttaagcataaaatcgcctttaagaaactgatcgaggtgcagctcagggagacgaatcttaattcaacccagggctttgctttcgtcgtcaacatcaggagaaattgggtgtttaacatttcctgtctcgagctttatcaggaaggctttgacctcacagattttgaagtgctccatgcggagacgcttcccgggttggacaatatcctggccccgaacgaggacttcgttggccttctcaagagcatcaacggcgagactgccattgtgagcactagcgagggtgcccgctcctattcactgcaggagctcttcattcgcaagactaagcacaacatacaggcgtacctcaacttcgccaccggggaaaaaaagtgcgaccagatccttgcagccgtgtcccaggaacgaatccggaagcagaaccccgtgaatcaattcagcgagatatccaacatcgcgaagcatcttttttcagacaaaggcaatccagtgctgttccagaatatggatggcttttgttttaaagttgacaccacgccgatgcaggtacaaaactccatgaacctgcaaactcccacgttcatctacgaccacgcgggtaccaagacgaacacccgcaacgcggaccaggggctgagctactacggcccctacgatagcctcaccttcgacattaagaagccaagagttctctctatctgccataagaccaaccgaggctcctttacgcgcttcctccacgacctcaaagacgggctccccaatagcagctggttcaagaagggcctcctgaagaagtacgagcttcaagaggtgaattacctcatccaggagatcagcgactacaggttggaggactacctggaagtgatctcaaactacgatgatgagaagccgcacctggcaatcatcgaaattccagataggttcaaaaaactgtccgaccgggacaacccctatttcaagattaaggcaaagctgctgagccttgagattcccgtacaatttgtgcgcagcacgactttgagcagctacagcgaatacatacttaatccgcttgcattgcaaatctatgcgaaactcggcggcacgccttgggttcttccggcccaacgctccgttgaccgcgaaatcgttattggcataggtcactcatggcttcggagtggcatgtataagggtgctgaaaacagcagggtggtcggcattactacgtttatgtctagcgatggccaatacctcctgggcgacaaggtgaaagacgtgccttacgagtcttacttcgaggagttgctgaagagtctcaaaagtagcataagcagactctccgatgagtatgcctggcaggatggcgacacagtgcgcctcattttccacatcttcaaacccatcaagaacgttgagttcgatgtcattagccagcttgtgaaggacatcagccagttcaacataaagttcgcgtttgtgaccattagcaagtcacacccgtctattctctttgacacgagtcagcaaggcgagaaaaagtacggctctaaccaggtgatagggcagtacatccctcagaggggtagcaatatcttcatagatgacgaaaccagcctggtgcagatgctgggcgccagggaacttaaaactgccaaacacgggatgagcaccccaatccaaatcaaacttaggacaccgcagggtaaccataacgaccaagaactgaaggatttgatgttttacgatcttaactacattacccagcagatctatagttttacttacttgagctggaggagctttttgccacgcgaggaaccggccacaatgctctactccaacttgatatcccgacttcttgggaagatgaggagcatccctgaatgggatgcggataagctcaattatacccttaaaaggaagaaatggttcctg

SEQ ID NO: 226 - DNA, 2307 bp, Artificial Sequence
  Description of Artificial Sequence: Synthetic polynucleotide
atgttggagacgaatatcagggtggtgcggcctggtccgcagctgtgcgttcctgtacgcagggtgatcgtgtccggtcaaaccttggctcccgacctcctggagaggctgtgtaacctgctgcgaaggaggtacggcattagcgccgcaagaataccgggctccgtgagcgagctgttcgttgcgaccgaccggcaggtggagaaggtgacactggaagaagataactggcaactgaccgccgtggactccaacgaccctactcgaatcatgtccatctctaacacggacgatgagagctttataagcatcctgatcgaacgcgcgctccttgcccagatcgccagtcgaagcctcttttggaccctcgactctcctcgaatttggtatgagaagaacccgttccaaaggaatgaaggcgtagccgtctaccacaggtacgaggtggatgcgctccccctcggcgacgcaggcattggcatctcagtggatgtttcaacggccttttttagcgagcacaccctggagtactacttcgcccccaacctgattagcggcgagagcaagacgcgacaggacgaattccacaagttcaccggccgacaagctggtcaaaaggggacgctgctttacaataacggcaggagtaaggtgaagtgctatttcgagaacaatagggtgggcctgacatgtggcgcaaccggccaaatgaaactcgagggaatcacgtatcccagcctgtaccactactatgcgagcaagtatagcgcattgcagatcaacgagaacgatgccgcagtgcaagtgtctttccctggcttggaccgcccagttccggtagccgccaggctcctgtccctccgagtgatgaacgacgacgtgcccgatggtctgagctccgtcgacaagatccctccaaggaaccgcaagtaccttatcgagcagttttggaagtgcctggagccgagacccttcgggaatgtggcccctggtgtcttcgacggcttctggagacccaacaacgaaagggtgcattacatccagctgcccgagattaactttggacaaggccaaaaagcagaaccgcctgacgtacgctccgttgcatccatcaaaaactattttaggcgacgactggaattgctgggtcacgcggggtgttaccactttccgccctcagcccccaggacaatcttctgcgcctacccgcagtcattgggtgaggagatcccggaaaagttggtgaacgggatcgtcaatgtgctgaacaagtggaccggcctcagcttctgtagcaacctggtaagctacagcacggccagcgaggcgtacggtaaattgaggagggccgagagtgccggcgtggtcctgttcatcttggacgaggagccggcagtctactacgacgcgagcttcaatcttgagggctggagggtaaagcgcgtaaccgagcctgtgctgcgccagcagcataagtatctgaccaacggcgtgtgggaccggaagaggcaagagtatagtttggggagggggcagagtcgctgggaaagcttcatcaatttgatcggattggacgttatccagcaactcgatgccattccgtataggatccccaacatcggcccctacgaaggccagctgataatcgacgtggggcatgacaggcaattcttcgccgtgtcactgcttattgtgagatcagaagacaaagtgcccgcatttaacatcagcagccaggtccagcacaaggcggatcataagcacgaaagcattaacccggtgctgttgaaggacaccatcattaacgtgttcaagaccgccaaacggaggacttttgatcctctgactagcctgttgatcatgcgggatggcaacgtgcagggcagcgagatcggcgggatagacaacgccctggtcgaacttaggcaacttggcataatctcccccgatgcgaggctggacatcgtgggcgtacacaaggaatctgtaagctccatcaggctctgggacgttgacgtaaggggggaggtaagcaacccgatcgagggcaccggtctgtcagtcaactcatctctgtacctggtggcgtgcacaggtgaggccacgctgacccaaggcaccgcagagcccgtggccatcgtcgcaaacaacaggtgcctgagtattgccgatgcagccctgagcgcctttctggcagcccaactgaactggagcagcccgggagtcgcccagcgcctgcccctgcctctgaaaagaacagatgaggaacttaccgctaggagcgatcaagaaattaggaggataagg

SEQ ID NO: 227 - DNA, 2055 bp, Artificial Sequence
  Description of Artificial Sequence: Synthetic polynucleotide
gtgcagcagacagtggagctcaccctctacacagaaaaacatcccgacacccacccagagctcgtttatgccgacgagtgtcccgacctgtggcaacagcacagcgagcttacgggggacaaatctctgttctactctcttacgaacccggcagaatgcaagggaacccagtacacagtgcaaatcaacctgaataaccagaagcagcgaaggatcgccaagcacataattagccagcaactgtataatcacttccgccagacccaaatcgctaccttcgacaagatcgacaatgtggaggtgtggaccaagaacacccaacagcctacccagaattgcacggagtacctgaggttcagccttataccccaatacgccgtgttctctgactcatgggagctggtcgtgtcctcaaatggcatatccaccgtgtataacaagcctttgagcgcactggaccttcagaccgaccgattcaaggtcgtcgttggaggggaagtggtcaagtacaagaacctgagccccaatcaaaagcaacaaatagacgaggccttccccaaaatcaatagggaactggccgctgaactgcatattaacgagaaacgctttctcaataaagacaagtatacgaccacctacaaccacattaacaacttcgtgcgacagcaccttctcacatccgagttccaggcactgttttgtctgagcggcgagatgttcaacgtacccgaggagcggatcggccaagtggcgaagggggcgaacctgttgcagtttaaggacggcaagaccggcattgacccattcagctgtgtgttcggcagcaagagcatggacgcactcggcatctaccaacccagcctgaagccccaggtgaaattctttttcatcgcccagcaaagcgatatcaacgtgtgcaaaagcctgtacgatattttcacgaagggatacaagccctacgtggacacagccactggcgagcagaggtacgtgttcccacccctggcgacgtgcatcaagcagcccttttcaaccgaccccaaggggagcatttacttcagcgaccctcaaaatgccctgagcgagatcaagagccagcttaacaataagcctcttgacccccaaacgcagtatgtgagcatatacgtgtcacccatccctcgcgacgccgtcaacaatccctactacggtctgtactttcagattaaggagctgctgctcgaaaagaggataacgtctcaggtgatctataaggaccgccccaacaaccagtacttcaacttccatctgcccaatatcgcgactgccatcctggcaaaaataggcggcatcccgtggcagttgaactcccacacgacgaacaaagatctggtgataggcgtgggcgccttccttagcgaaaaagttggcgagaggtatgtgggcagcgcgttcagctttaaccccaacggcctgtttaagaacttcgactgctgtaaagcgaacgatctcgaatctatcgtagccgggatcagaaaggccatcggacacttcgttgtggacagcgaaacaaacccccagaggctgatcatccactactacaagaccatgtcaaagagggaggccaggcccatcacgcagatgctgaacacgcttggcctcaacattcctgtattgatcgtcacaataaacaagacggagaccagcgacattgttatgtttgatgagaaacagcagggctacatgcccctttcaggcaccgtactgaagataaggaacgatgatttcctgctctacaacaatagcaggtacaaagagaacgaaaagtcagatatgctttttccagtgaggatccgcctgagtaagatcgtaaaccaatccgacaaagacatcccaatgacagacgccttcaatttgctcaaccaagtgtaccagttctcacgcatgtattggaagagcgttaagcagcaaaacctgccgatcacgataaagtatccagagatggtggccgagatagtgccacacttttcagaagccgaattgccgcagttcggaaagaataatctgtggtttctg

SEQ ID NO: 228 - DNA, 3009 bp, Artificial Sequence
  Description of Artificial Sequence: Synthetic polynucleotide
gacctgttcctgggcgctggcgcctccatatctagcggtatcccttccggaggcgacctcgtctggcattttaagcgcgaaatactgaattccaacgggaagataaatattaaaaaatttcaagatcttaagatagaagataataagaaggttatacaaagtttctttgaggagactgaggagaacaacattattaatccttattcctattattttaacaaatgttatccagaccccttgataagaaaagaattcttgacgaatcttgtgagggacaagaagccttccataggatttatgtgcctgtctgctctcgtggagcagcaaaaaatcaacacagtatggacaactaacttcgatgacttgattgagaaggcgattaacggattgaattacaagtcctgtcaaattgtctcacccgagaatgcgggcagcgtgaataactttcgaactgatatccccactgttgttaagcttcacggagattttaggtatgacccactgcagaatactgacgaagagttgcagaaactcgaagagtccttgcataagtatttcgtagaggcaagcacaaagaggggacttctcgtaatgggctattctgggtcagatgagtctgtgctgcaaagccttgagaaggcgctggaagagaacaacgcgttccctaagggactcatttggtgcatccccaaaagtgtcaccccaaaccaacgactggtccgaattatatctaaggctaatgagcagaaccagcggtccggatttatgattatcgacagtttcgattatttcttgcatgaactctacaaaatatgcgaccttacgaatgactatatcgactctattaccaaggagagatttgaaaaaaggcagtcatttaggcttaaccaaactccgtcctctactctgccaatcttgctgaacgcaataaaagcaaagcacttcccgaaaagtacctttctgactaaaacgaatatctcaggcataggtaagtggaaacgcttgcgagacgctataggaaatagctctatagtcggatctttcggtaagaacgattctctcagactttttggaagtgaacaagacattaataatgtacttaagaactacttgattgatgatttgaagatcagtgatatcccagagcacctttttttccattctgattcattctacattggcatgctttatgaactgattgaaaagtgtttgattaaagattatgggctgtcagtatatgcaaaggggagaactatcagaaagttctattcaatcaataacccgctgccggaatctgaaatcgcagatattaagaagagaaacaataattttaacatcgacaaaaatataaatgtatttgaggcgttcgagttctccatagaattcattaataaggagctgttcctgttgctgtgtcccaccatacatattcagactaaactcggaggtgaggtcaatcgcaatatctctcagtacctgtcaaacacaatcatcagcaataggtataataacaaatatgggaaaaagctgaattggtggattaacgagctcaagaagtataacaaggacttggtttttaaattgggggactttgagatacgattgacagattattactccacgagcgctaagcgcgttaaagatgacatctactgttttgacggatttactaagttgagtgagcccagtatatatttccactatcaagacgaagcaaagcagagtatccatcccataagtggactgaagatactcggtccattggaagaatcattcgaggcaaacggtacatcttccacagtcaaccttgccatcattactccggactttggcttctccaaactcaaggcgcacctcgaaagtttgcttaatacaatttcccctatatgggagaaggaatacttgaaggagttccctggtttcgataacgtttttaagaagcacctgataatacccaattctattcaaagcgagtatgtaatcagcatacctaataatgatgtaaaacagttctcagcaattcaattctacgactacctgaagagtaagatcgaccgactcgctctgaagtccaatgacattgattgtcttgtaatatacatacccgaccagtggaagaacttccgagagctgaaaaatgaaaacacatattatgaccttcacgacagtcttaaactctactgcgtaaaaaaggggttgcgaatccagttcatcgaagataaaagcattaattataaagaccaagccaagatccggtggtggctgtctctggggctctacgtgaagtctaacggcactccctggaagatcaaaacagataatacagagactgcctttgtgggcctcggttacgctatacgacaaaatgttaagaataaggttgttctcgggtcttcacagattttcgacggttatgggaatggtctcaagtttcttttgcagcccatagagaagccaattttttacaataaaaaccccttcatgagcaaagaggactcttttcggcttatcagtaatatacgaaacacatatcataagatcgatccagttatcggacttaagaaactcgtgttgcataagacaactcattttacttcagaggagatggaggggatctctaatgctttggaaggcatagacaatattgaactcttgcagattcagcaattctcatcatggagggcaattaagcttatgaaaaatgccacaaagcacgattttaatggttatccgatcgatcgcggaactataattcaactcgacgacttctctttccttctgtggacacacgggcttatagagaaccaagagctgaacggtaagtactaccagggaaaaagaggaataccggctccgcttcttattaagagatttagaggcacggatccaatagagacggtggcaaacgatattcttaagctgaccaagatgaattggaatggtgcagagctctataaaacctttcctgtaacgattgatttcagtaaaaaactttcagtcatggggaag

SEQ ID NO: 229 - DNA, 3006 bp, Artificial Sequence
  Description of Artificial Sequence: Synthetic polynucleotide
atgccttcagctcaacggtgcatctgggagtggaagagggatatcttcgtgaccaagaatccgacgctccgggagtccgtggatgaacttagcttgccagggaccaggcgcatcgtacagggatggatcgaccagcaagcccaatacccggaagatgggtcagcagacgaatatagcttttatgccgaagagtgctacccaacctctcatgaccggcgagcgttcttccatcgcttcattgccgaggcgagaccgcatatcggctacaagctggttgcgcagttggcagaagcagggttcttgagaaccatttggacgaccaactttgacggactggttagcagagcgtgcacagcggctaacgtcgtgtgcgtggaagtgggcatggacacaccccacagggcctcacgaccgcaaggggatgacgaagtcagactggtgtccctccacggtgactttaggtatgacctgctgaagaacaccgccaatgagctgcgcgagcaggatttggcccttagggaggaactgctgcacgaactcaaagactacgacctggtggtcatcggatattcagggcgggacgacagccttatgcaagtgctctctgctgcctacagcgaccgcgcatcttgtaggctctactggtgcgggtttggcgcggaaccagcaccggaagtgaggcaccttattaagagcatcgacccagcccgagagagcgcgttctacgtggataccgccggatttgacgacgtaatgagcaggcttgcactcaggcgactgagcggtgaaagcctcgaaagggcccagaagctcatagaaagcgtcaccccggttgctggcaaaaagatggcctttagtgttccaccattggcccctagcgccttggtgaagggtaatgcctaccgattgacctgtccggcaaacgtcttgaaacttgatatcgaacttcccgagcacggttcctggcgcgattggctgtccgaacgaatgactccagaaagggggcaggccgttgtgttcgagaagggagcactggttttggccgacatggcggttaccgctaaagttttcgatggatttcttagggtgagcccgacacgggtggagataagtgacgagaacatcatcgctgacggccggatcgccagtctttaccgacgagctctcgtgagcagtgccgcaaaagcgctccagatccaaaccgaccacaggaggaggatatgggagcccgtgcactatgatacaaggcaactcgacgatgtgacgtaccgcgtgcatcgagccgtctccctgacgatagtagggatagagggagtgccccatgtggtgctgatgccagaggtcgtcgcatctacgttggcgggcgaccttgcgccggttgacagtcaaaagactctccgcaatgccatttacgggttccaacataacgataagtttgatgccgacctcagctattggacccaccgccttgttgagaaggagctggcttccagcggcgagggcgttttcgtattgagcaaagtgccactttatgcgggcctggcacaaaaaggtaaagctcctctcccacacaggtttgcacgccacgctaaacagcatggaattattgtgcccgacgcaccgcttgttttcagcgccaaggttggctctggagaggtacgaaaccccaatccgctgcatgggctggtgcaaaaccggccatgggaccactctcttacggcgtctggtttgtgtccgagtacagatgctagcgtgatctgccccgcagacgctgctccgaggtttgagagattcctccaatctatgcaggaggtagcaagaccaagccagagcgagagggactatttgcatgattttcccggcttccctgcggcctttggactgccactccgaatgcccgtgagaggggacgcaaactggattaccatcgacgacggagtgagcaccgatgccctgacaggggctaagcaactggcgcaccgagtgtgccaagcactcgaccacctccgcagagcaaggccctctgacacggcgatcgtgttcgttcccaggagatgggaaccatataaggtagtggacacgcagcacgaaagattcaatttccacgattacattaaggcctacgcggccaggcacagtcagagcacgcagttcgtcagagaagagaccatccaaagccaatacgtgtgtagggtccggtggtggttgagtttggcactgtatgttaaggctatgcggaccccctggcggctggatgcgcttgatgagaatacggcttttgttggtatagggtactccctggacgcagaggcagggaggggcaaccatgtactgctcggctgcagccacctgtattctgcgaggggtgagggattgcagtttaggctgggccgaatcgagaatcccgtggtgcgaggaaggaaccccttcatgagcgaggacgacgcaaggaggaccggagacaccatccggcagcttttctacgatagcaaaatgcatattccgacaagggtggtgatacacaagaggacaaggttcactgacgaggagcagagggggttggtacaaggattggacggtgtgaggaatatcgagctgatagagatcaaccaggaagagagcttgcgatatctcagcagccagatgaaggacggcagatttgagatcgacaagttccccctgttcaggggtaccacaatagttgagtcagatgacactgcattgctgtgggtgcatggagccacacccagcgccgtgaacaagtactggaggtactaccaggggaagcgccgcattccggcgccattgaggattcgaaggttcctcgggcaaagcgacgtagtgcagatcgcgaccgagatcttgggactgtctaaaatgaactggaatacgcttgactactattcaaggatgcctgcgactctggattctgcaggcagtattgccaagttcgggtcatatcttgatgggtttacgagcgcaccctatgattacagacttctgatc

SEQ ID NO: 230 - DNA, 1941 bp, Artificial Sequence
  Description of Artificial Sequence: Synthetic polynucleotide
gttcacgcattgctcgctctgctcgcgaaccgagccggtggaaggaccgccagaatgggagacagcttgctcacgtggagccctcctgagtctctgctgcttgaagggaccctgagctggcgcggcaacacctacacataccggcttcgcccactggcgagaagggtgctcaaccctaggaatcccagtgagagagacgccttgtccgcgttggcgcgacgactcctccgagaagtgcttgagcaattcaggcgcgaggggttttgggttgaaggttgggccttttacaggaaggagcacgcacggggtcccgggtggcgcgtgctgaaaggtgcggcgctggatctgtgggtttcagccgagggggccatggtattggaggtggatccgacttatcgaatcctgtgtgacatgacactcgaggcgtggcttgcacagggacatccacccccgaaacgcgtcaagaacgcgtacaacgacaggacatgggaactcctgggtctgggtgaggaggacccgcaaggcattcttttgccaggcgggctgaacctcgtcgagtaccacgctagtaagggcagaatcagagacggcgggtggggtcgggttgcgtgggtggcaaatcctaaagacgccaaagagaagatcccgcatttgacgagcttgttgatccccgtcttgaccctggaagacctgcatgaagaggggggctctaacttggccctctccatcccgtggaatcaaaggcaagaggaaacccttaaagtggccctgtccgtggctcgccgactcggcgtcgaacaccccaagcccgtcgaggccaaagcctggaggatgaggatgccagagcttcgcgcacgacgcagggtgggtaagccagcggacgcccttagagtggggctgtaccgggctcaagagactaccctcgcactgcttcggctcgatggcggcagaggatggcctgactttctgcttaaagcattggagaacgcttttagggccagccaggctaggcttcatgttagggaaatccacgcggatcctagccagccccttgcatttagagaagccttggaagaagcgaaagaagcaggtgtgcaggctgtcctcgtactcacccccccactgagttgggaggagcgacaccgcttgaaagcactgttcctcaaagaaggactcccaagtcaacttctgaacgtccccatacagagggaggaaaggcatcggttggaaaacgccctgctcgggctcctggcgaaagcgggtctccaagtagtcgcccttgagggcgcataccctgctgatttgacagttggatttgatgccggaggccgcaagtcctttaggttcggaggtgccgcatgtgctgtcggctccgacggaggtcacttgctgtggagtctgccggaagcccaagcgggcgaacggataccaggcgaagtagtttgggacctgttggaggaggcgttgctggtgtttaagagaaaaagagggcggttgcccagccgggtgcttctgctgagggatggcaggcttcccaaggacgagttcaccctggcacttgcaaagctgaggcagctcggcattggcttcgacctcgtgtccgtaaggaagagtggaggcggaaggatttatccgacccggggaagattgcttgacggccttctggtgcccgttgaagagaggacttttttgctcctgacggtgcatagggagttcagaggcaccccacggcccctcaaattggtacacgaagaaggtgagacacctctggaggctctcgcagagcagatctaccacctgacgaggctgtatcctgcatcaggtttcgcatttcccagactgcccgcacccctgcacttggcagataggctcgtgaaagaggtgggccgattgggcgtgaggcatctcaaggaagtagacagggaaaagctgttctttgta

SEQ ID NO: 231 - DNA, 1845 bp, Artificial Sequence
  Description of Artificial Sequence: Synthetic polynucleotide
gtgaggctggtaaaccagaaagagaaaccggaaggcgactacgtgtatggctacactctcccaatagaccccagtaacaggaacatgaggcagcccttctggataagcatggataaaaaggagggctatgaagctcatttcgttggcccctatgagaacattgagttgaccaagagcgtgatcttctgggaccttctgaggaggaccagggagcaactcagcagcgataagttcacggaatcaagaaaaaagttctttaaggagatctacttcccccttaacctctacaatgagggcagccaagggctcgccgtgcaaccctactacctgaagattgatcagcaatttggactgctggtggattttcaattcaaacttgacaaagatttcaccttcagccggaagattcaacagctcagtctgacattggatgggaagaaccggaggaacctcaactactacgtcgacaggataaccaaaaccaaccaattcatcaaggccctctggaacatcattggcaccttctcccataatgaaaacaaggaaaactacacgctgaggaacgacttctacccctgcgccgcaagcaggctgcggtctcgaatgtatctcttttccaatggcagtgaatccaggagccagttcaatggcttgaaggaatacggcccactccgacccctgacagccaatccgacactgctgtttgtgttccgggaacaagaccgcgacgccgcgagaaaactggcgatggcacttaaaggcagcaaaaagcaagatcaatacagcttccccgggttcaactccctgtttaaagcggacctgttgatcgacggaaatcccatggtcttgaaagacttttctatcgagagcagcagggaggtgttggccagggtgacaacatcaacatccagcttgttgcccattttcatcctgcccaaccgcgagggcgacggctacctggagcacaaagccatcttcgccgagaacggcatacctactcaagcgtgcacactccaagtcattcaggacgacgtgacccttaggtggagcgtccccaacatcgccctgcaaatattctgcaaagcgggtggctggccctggaaagtgcagagccccgtaaccgacaacgccctgattataggcataagtcagagccacaagttgaattatagtgacggtaagacaactgtggacaagcacttcgcttttagcgtgctgactgattcaagcggcctctttcagaaaattcaggtgctgagcgagcagaagacggaggagacctacttcgaacaactgaagctgaatctcaaaagcatcctgaacgccaatagcaagaactaccaacgcatcgtgatccacacctcatttaagctcaaatacaaagaaataagtgcaatcgaggaagttgttagcgaatttgcaaggaacagcaacagcgccgactgcaagttcgccgttgtgaaggttaatcacaagcataggtacttcgggtttaatcgggaagtgaatagcttggtgccctacgagggaaccgtgtgtaagctgggcgatagagagtacctggtctggttcgagggtatctatcaggagaagccgaccgttaccaaagcatttccgggtcccacccacatcgaatttcttaaaatcgggtctaataacgtgattagcgacgaccttttgttgcaagacctgatgaacttgagcggagcgaactggagaggctttaatgcgaagagtgctccggtatccatcttttactgccacctggtggccgacatcgtgcatgatttccaaatcaaaggcctccctatgcccgccatagatcttatacgaccctggttcatc

SEQ ID NO: 232 - DNA, 2109 bp, Artificial Sequence
  Description of Artificial Sequence: Synthetic polynucleotide
atgcaagaacacctgaagacgaacatactgaactttaaatggcccaactctgctccgaccatctacctgacattggaggacattgaggggagccaccctatccacaaaagcaaattttctagacagataaaagaagtgttccccgacgcggatttgagtaacaaggaccagatctttacgacattcacgaccgaaatcccagacgccccaagcataaaactgaaccttgtggacggccgagaattgcggatctataaacagttcctcaagcacaagctgcggtcatatttcaaatctaaggactacatcgtggtcaagaatttcgtgggcgacgttcaagtgtggatgccgagcaaaaagggtaacaccgcagattacaacctgtactataagtttagctttaagatccaatttgccaaactgacggacctccccgagctgatcgtaagctacgatggcacctccaaggtgctcacgacgtccgttaaggacatcgaagattcagagctcatcaagcgatgcgtctacggccaaaagacgtttaactaccaaatggacttggacaccgaagagaagcaagagttttacaacgcgatacagtttgaccaggcctacccaattttcaacctttccctggcaagggcactcgacatccccatagaggagccaataaggccgatcaacaaataccaaaaatacgtagccctgattaacaatttcgcaactaattaccttttcaaggaggacttcaaggttatcttcccgtttaaaacagacacgttcatcgacgtgcctataaatcggataaatcacatcgacccccaagtcggcctgttggaattcggaaaagatcaatatggcaacaagaaaacccacctggtacctaaaaaggcaatgaacatcttgaatccataccggcgacctaataatcagaacatcaaaatctttttcatctgtcacacaagccacaaagactccgtgctcagcttctatcagaatctgaaggaaggagtaaacacggagaagaactactacaaaggacttgaagcctacgtgaacattaaggcaagtagtagcaaggagcattttatcgagttcacgaacgagaatgaccccatcccggagatcgtggagaagcttgagagcctcacatttgatcatgacaatgttctctacgcggcgttctatctctcccccttcgacaaattcacccagaatccggaggaccgggaaatttacatccaaataaaggagttgttcctgaacgaaggtatcgtgacccaagttgtcgattacgagaaaatggtcgtcaatatcgagaatcagtataacttccagttcagcctgcaaaacatggccctcgccattcatgctaagctgggcggtgccccgtggaagctggccgtgaccgacaagaaggaattggtcatcggggttggagcgtttacaaatcaaggcgagaacagacgctatattgcttccgccttctcctttcagaataacggcctcttccgcaagttcgagtacttcgatcaaagcgagaccgacctcctggctggcagtatctgcaaagccatccgcgacttcaccagcgtagcggaggcagataaggtcgttatccatttctataaggagatgagttacgaggagcttaaacccatcattcggggcatgcacacgcttgggctgaagatacccctttacatacttaacataaacaagactgaagccgaggatattatcgcctacgacctgaattggaacaaaaagctgatgcccgtcagcggcacctacattcgcatctccgaaaatcatttcctgctcttcaataacgcacgatatcctaattcccaacggtacgccgacacggatggttacccgtttcccattaagattaaggtcagctctccggacgaggatgcctttgaagatgcagatgtggtcctggagctgcttactcaggtttatcaatttagtagactgtattggaaaagtcttcgccaacaaaatgtacctatcaccatcaagtacccagagatggtagcccagattgccccccatttcaacaacggggtgcccgacgatgccaaggatgctctgtggttcctg

SEQ ID NO: 233 - DNA, 3156 bp, Artificial Sequence
  Description of Artificial Sequence: Synthetic polynucleotide
atgactgaggacttgtacctcgactacgacgcgttcctgcggagctttaaaagaaacatagatgtgccgcactcctttctcctgggagcaggtacatccattagcagtggcatccagaccgcctacgattgtatctgggagtggaaaaaggacatttacctctccaagaacatcaacgccgctgagttctataagaaccataaggacgaggcggtaagaaagagcatccaaaagtggctggataaccaaggtgaatacccagttctcgacagcacggaggagtattgcttttatgccgaaaaggcctatcccatccccgaggaccgccgcaagtattttctgtctcttatcgaaaataaggagccctacatagggtataagctcctctgtctgctggccgagcgcagcattgtaaaggctgtctggactactaatttcgatggcttgaccgtcagggctgctcatcagaacaagttgacgcccattgagataaccctcgataactctgatagaatatttcgcaaccagtctaccaaggaattgctcacaattgcgctgcatggtgactacaaattctctacgctgaaaaatacggagaaggagctcgacaaccagaacgacacattcaaacagcagctggggacgtatcacgtggacaagaatatgatcgtaataggctactcagggcgcgacaagagcctcatggacgccatcagcgaggccttcagtacgcggggtgcagggaggctttattggtgcggctatggcgagacgatccccaacgaggttagcgagctcatactgaaaatcaggtcccagggtcgcgatgcatactacatatcaacggatggatttgacaaaacgctgatacacctgtctaaaagtgcgttcgaagacaaccccgagattacgaaaaacatccaactcgcgctcgaaaacagcgcggacgaagagtactttaagactgacttttcactgaactttagcaagccggataagttcatcaagtcaaacctccaccccatcgtgttcccgaaagaaatctttcaattcgagcttgacttcaaggaggacaagccttggcaactcctcaaaactatttcacgcgagacaaacatttgcgccgtgccgttcaagggtaaggtgttcgcactgggcacgcttactgacattgggaacgtcttcaagaaccgcctgaagagtgatataaagcgcgaagcaattagcacctccgacgtggataatgtgagtgcctttaaatctctgatgctgcaggctgtgctgaagtttttcattggtatcgaaggcgtggagtccaacctcaaagacagattgtggcttaccaacgcggagcagctcgtgggtgatattagtgtgcataaggctatccacctcagcctgtacttcgacaaaaacaaaggattcgcttacctgtccttcacccccaccgtacaactcatctctcctgaggaaatcagcaaaatccagaagcagagaatctctaagagtaaactcgagaagctgttcaatgacaagtatgacgagatattggagttctggaaccaaaagctctttaacaatagccaaatcaagttcgagtacccgatcagctcaggtagtgggtttgagttcaaaatctccgccaacaccgcatttggggagataaacgtattggaccccaactttcgctccttttcccctagaaattatgacccgaagcgcacacagtttaagggcgtgcagttcctcgaaccgcagctgatattccgcaacatcagtactaatgtggaatttaaggactaccacccgatgagggggctggtgaacaaccgaccgttcgacgtgaacctgaacggtataattcattctaacgaaataaacctcacggtcatctgcggcaagtcatacgccaacgacctgtatgaattcctgagcaagctccaagtgaagcacgccactgagaatgtcaacccggactatcttattgagtatccgggcttccaaagtgtgttcaacctgccactcaacataccccactttgactcttccgagaagtggtacgacatcgacttcgtagctgacaataacggggagaaccacgagaatgccattaagcttgccagactcatcaccaccaagatcgaccagattgcctctacacagaaccagagcacggtcgtggtgtttattccaaatgaatggcagttgtttgaggggtacctgaatcagggggagagtttcgatttgcacgattacatcaaggcattcagcgctagtaggggcatttcaacgcagctcatccgcgaggatacactggcggatacgttgaagtgccagatctactggtggctgagcctctcattttacgttaaaagcctgcgaactccttggattctgaataatcaagaaaagaacacggcctacgccgggatcggttatagcgtgactaaaatacaggaccggacggaaacggtgatcggctgttcccatatttacgattccaacggccaggggctcaagtatcggttgagtaaaattgacgactacttccttgacaatcgcaataatccatttcttagctataaggatgcgttccaattcggtgtgtccatacgggaattgttttaccagtccctggacaaattgcctgagcgggtagttatacacaagcggacccgatttaccgatgatgagatcaatggtattaaggcgtctctgaacaaggcggggattaagaagattgacctggtggagattaactacgagacggacgcccgcttcgtggccatgtccgtataccagaatgcactgcaggtagaccgattccctatcagtcggggtacttgtatagtcacaaataagtacactgcccttttgtggacgcacgggattgtcccaagtgtacggcagccaaactacaagttctaccttggcggtagaagcataccggctccgatcaagatcacaaagcattatggtgatagtaatatagacgttatcgccaccgaaatccttgggctgaccaaaatgaactggaactcccttgacctttatagcaaacttccctctacgatcgactccagcaatcagatcgctcggattggcaaactgctctcccggtacgaaggcaagacgtacgactatcgattgtttatc

SEQ ID NO: 234 - DNA, 2049 bp, Artificial Sequence
  Description of Artificial Sequence: Synthetic polynucleotide
atggaaaatctgaccctgaatatcatccctttcagccaccccgtgcaggagcttgagatcggcttctataagcaagagaaacagggatgctacagcctgtggaagggcgagtacccgcagtcattctgggacgacttcaacgaggaaatgcaaaattgcgacaaactctacaccaacttcattgacacggaaaactgtgattacaaagccagtgtggactttagcaaaaacagacgcctggcggtccattactacagcaggctgatctacaactactttgaaacagtggcagatgccgtgaaaatcaacttcgtgaaagatatccagatatggttcaaggacgagaccaagagcaccgccgtctataccagttacaagcggttcacgatcaaggtccagttccataaggtgaccgagtccccagagctgttgatcagcttcgatggcaataccacggcctataacaaaagtctggccgagttggacgatttccctcccgagctgattaactacgttaagtacaatacccaagtggtgaagtacgagttcgccgaggacgctattaagcagcatatcgaggagctgtacccgatcctgagcaaccccatcagggactaccttaagattgccaggcccgattttaagaggggcaacaagtataagccctactacaagaacattacagacttctatcacaaccacctgaactccaaagagtttaaagctatcctgcctatctccgaagacggtttctacaaaatgcctaagcacaaggttcacaaaaccagcttcaatagcaataaactgagatttttcaataacacggacatcgtgccccacaacgggatgaaaaacatcggcccctataaggcgtccccccaccccaacgtgaggttcttcttcatctaccataagccagaccgaaacttcgccgtcaagacgctgtacgaatactttacggaagggtacaagagcccagagggctacctttacttcaagcctctcaaaacctacattaaacagccctttctcatcgacaaggataccagcatcgcgttcgaaagcccggaaagcgctctgcgcgaagtcaagcagggtttgcttaacctggaaaagcagcccaatacgaaatacgtcgctatctatgtgacccccatacataagaccgagaccgacgagcagaggaagatgctttattaccaggtcaaggaagaattgctcaagcacgacatatcaagccaggtgatatacaaggacaacattggacataaggattttagtttctatctgcccaacatcgccatcgccctgctggccaagatcgatggaatcccctggaggctggacagagacactaaggaggaacttatcgtgggcgtaggcgcattcacaagcctgaaccacaatatcaaatatgtagctagcgccttctgctttaacaacaatggggaattcaagggattcgactgcttcaaagcgaatgaaaccgaacttttggctggcaccatcggcaagcaaatcctgaagtatgtggtggacaacggcgagagcgccaagcgcctgataatccacttttacaaaaagatcagtaacaaggaactcgagcccataaagaaaatgctgaacaagctgaacctgaccatccccgtagtgatagtgactatcaacaagacgacctcagaagataacgtggcgtttgacaccagcagccataacctgatgcccgtgagcggcacctacctcaaaataggatgggaccagtacctccttttcaacaacacgagatacaacgccagcgacaccgagaaggataaccccttccctgtaaagctgagcttctctagcaccgtagacaattacttcgacgacaggaaggtggtcgaggaattgatcgaccaggtgtatcagttctcccgcatgtattggaagagcgtgaagcaacagaacctgcccgttaccatcaagtaccccgagatggcggcagagatcttcccattttttgaaggcgataagctgcccgacttcggaaagaataacctttggtttctg

SEQ ID NO: 235 - DNA, 2115 bp, Artificial Sequence
  Description of Artificial Sequence: Synthetic polynucleotide
atgaacacgcctttgacgcattacgtgctcaccgagtgggaatccgatacaaatactaatgtattgcacatccacctgtacaccctccccgttaggaacgtgttcgagcagcacaaggagaacggtaacgcatgtttcgatcttcgcaagctgaataggagtctgatcatcgacttctacgaccaatatatcgtgagctggcagcctatagaaaactggggcgagtacaccttcacccagcacgaataccgcagtataaacccaacaatactggccgagagggccatcctcgaacgactcctcttgcggacaatcgaaagcgtccagcccaagaaggagatcgcagctggttcccgcaagtttacctggctgaaggcagagaaggtcgtggagaacattagcatccacagggtaatccagtgcgacgtaaccgtggactacgccggcaagatctctgtgggctttgacctcaatcacagctataggacaaatgagagcgtgtacgacctcatgaagtctaacgccatctttaagggagaccgcgtgatagacatttacaataacctgcactacgagtttgtagagatttccaactccacaataaatgactccatccccgagctcaaccaaagtgtcgtcaactactttacgaaggagcgaaagcaagcatggaaagtggataagctggaacagagcatgccagtcgtgtacctcaaggcattcaacggcagtaggattgcatacgcgcctgcgatgctccaaaaagagctgacctttgagagtctcccgaccaacgtagtacggcagacgtcagaaatattcaagcaaaatgccaatcagaaaatcaagaccttgctggatgaaatccaaaagattcttgcccgcaccgacaagatcaaattcaacaagcagaagctgttggttcagcaggccggctacgagatacttgaactgtccaacccaaacctccagtttgggaagaacgttactcagacgcaactgaagtatggactggataaaggcggagttgtggcctccaagccgctcagcatcaatcttctggtctacccggaacttatagacaccaagctcgatgtgatcaacgatttcaatgacaaactgaacgctttgtcccacaaatggggcgtgcccctgagtatcctgaagaagtctggagcgtaccgcaacagacccattgatttcactaacccccaccagctcgcgattctgttgaaggaactgaccaagaaccttttccaggaactcacgcttgtgataataccggaaaagatcagcggcatgtggtacgatctggttaaaaaggaatttggcggcaatagcagtgttccgacgcaatttatcaccatcgagacacttcagaaggcaaacgactatattctggggaacctgctccttggcctctatagcaagtccggcatccaaccatggattcttaatagcccccttagctccgactgcttcatcggtctggacgtatcacatgaggcgggtcgccacagcaccgggatagtccaagtcgtaggaaaggacgggcgcgtgttgtcatccaaggcgaatacgagcaatgaagccggcgagaagatccgccacgagaccatgtgccaaatagtgtatagcgccatcgaccagtaccagcaacactacaacgagaggcctaagcacgtgaccttccaccgcgacggtttttgcagggaggacctgctgtcactcgacgaggtgatgaactccctggatgtccagtacgacatggtggagatcatcaaaaaaaccaatcggcgaatggcactgaccgtcggcaaacaaggatgggaaaccaagccaggactgtgctacctgaaggacgagagcgcctatctgatcgccaccaatccgcacccgagggtgggcaccgcgcaacccatcaagattatcaagaagaaggggagcctccctatcgaggccattatacaggacatctaccacctgagcttcatgcatatcggctcactgcttaagtgccgactccccatcacaacttattacgccgatctgtctagcaccttctttaaccgccaatggcttccgatcgatagtggcgaggcccttcacttcgtg

SEQ ID NO: 236 - DNA, 3129 bp, Artificial Sequence
  Description of Artificial Sequence: Synthetic polynucleotide
atgattaacaaactgcaattcgacgagtttcagagggccataggtatttctaagaacgacaccttcagtcttttgctcggagcgggttgcagcatcaatagtgacatccctagcgcggaagactgtatatgggagtggaagcgagatatttacaaaacaaataacagttctagcttcggctggattgacaattacaagaatcccaagactcaggagatcattcagaactggctcaacaaccaaggcatctatcccgaacgcggctgcaaagaggagtacagcttttacgcctacaaatgctatcccatcgacgaacataggcgacagtattttcagaaaatctgtagtggtaaaaagccatccatcgggtacaaacttattcccctgcttgcccgaaagggcatgcttgatagcgtgtggaccacgaatttggacgacctcgtggtgaccgcctgtataggcaacgggatccaggcgatcgaaatcacgctcgactccgtgcaaaggttgaacaaccggcctcagaaccgacatgagcttcctgtgatcaaactccacggagattttaagtatggcgatcttaaaaacaccgaggaggaactcctcaatcaggataaaacgttcagggagagacttattgaatacgtacaagacaagcacctgatcgtgctcggctacagtggccgagacaccagcctgatggacacacttaaagaggcctactcaaaacaggggggtggaattctgtactggtgtggatatggtgacaacataaactccgacatcgccgaactgattcaaatagccactaaaaatggccgacgagccttttacatccccactgatggtttcgattctacgctccggaaaatcacacagatagtggtcgaggatgataacaacctgaaaaaagagcttctcgagcttcaccagaccagcaatatcaatgacactatcacaccttttgatctgaagtgcgagagggtgaataagctgttgaagtcaaacatattccggattagctttccagacgaagtgttcgttttcgatgtgagcatcagcgataaaccctggaagttcgtggacgaaaggactcttgagcgcaacgatattagcgccgttccctataacaagcaaatctgggcattcggtaggcttgacatcataaaagacatcttcaaagacgtgatgaactcagacattcagcgaaaacccctggcaaacatcaagatatacaacacggcggttagtcggctgttgcttactacgatttgcaagatactggcgctgcagagcaaccttaagaccgactataagggtaagatatggaccgagaacaacagtaagtccatttccggccacatagtatacaatgccgtgctgctgtcctttgatcggataagcggtgagtattaccttagcctcaaccccgacttcgtgctggctaaccccaacattgagaagagtagcatacagaccataggactgttcttcttccagaagctgtggaatcagcagtttaacgagtacattaactattggagggaaattttgttgaaaaagaataatgagtacgagttccccataaatagcggaaccggcttcaagttcaagatcaagaacatcccagtgttcactaacatctgcgacctgaataaccctcgcatcaacaatcacaacgtgtccagccaccacctgctgcttcagggggtgcaatttaaggaaatcccgctgcttttcagcaccaacaatggcaaccgcacggccaccgacacccaccctatgagaggacttctcataaacaaaccgtatgaaacgggcgtcaacgacttcctcgaaaagtctatcaccctgggaatcataagccccagtcaggacgccctcaggttctaccaattcctggaaaaccagaactctaaaatcaaaaagcacaacgacaaggacaactacataatagactacgaagggtttttcgccatctacggcgttagtctcagcttcccaacacctaacgacaacgagtgggaaaggatcaacgaaccgctgattatgggcatcaaggagaccgcccaacagataaagcaactgatatgcgacagcatcgtgaagatctcaagcacgaccaggagaaaaatcatcgtcatctatatcccccaacgctgggagccctacacctcttaccagctcgatggtgagtcatttgacctccatgactacgtgaaagcgttctgcgcggagaaagggattatgagccaactcattcgagagaagaccattaacgatactatccaaaaatgccagatacattggtggttgtctctgtcatttttcgtaaaatccttccggaccccatggattctcgcaaatactaacaacaccaccgccttcgcgggtttggggtacagtgtagaaaacaagaaggatattaacggacatattgtgctggggtgtagccacatttacagctcaaacggagaagggctcaaatacaagctggccaaaataagtaatgataagattcagtggaggcataagaagccgcacctctgctacgacgacgcgtatgagtttggcaagtcaattgtgaacctgttctacgaatctatgaacgaactgccaaaaagggtggtcatccacaagaggaccttctataccgatgaagagaaacaagggatcatagactccattagcgacaataagaaaatagagagcatcgacctcatcgagatcaactttgaaaacaatataaagtacgcctctagcaaaatccacgacggaaaggtagacattgacggatttagcgtatctaggggaacctgcatacaactcagctctaaggaggcgctcctgtgggcgcatggagtgattcctagcgtcattaaccctaactggaacttctaccctggcggcaggtacatacctaaaccacttaggatcattaaacattacggtacaggtagcttggaacagatcgcgaacgagattctgggcctgactaaaatgaattggaatagcctgaacatgtacagccaattgcctgccacaatttcaagctccaatgatatagctaggataggtaaattgataggggcgaacagtatgcacgaatacgactaccgatacttcatc

SEQ ID NO: 237 - DNA, 1917 bp, Artificial Sequence
  Description of Artificial Sequence: Synthetic polynucleotide
atgaataacatacccatcaggctgaactttttcgccctgaagaaccagaacattagcttcaggatctacaggcaggacttcaacggccagaaaaaacaggacgggtactacaggaccaagctgcccatcaacgactcttctgacacctacgcggagtactgggtgacaacccagcccaaggatggcttcgagagggtgtactgcctgggttcctcaaaccctaagctcaccgtccgaatcatgtgggagagcttcctggatagggtccagaagtccctgagctccgacgaatatatcctttacggtaacggatttagccggaaggtcgccgtgatcatcggcaggcacagggagggcaatgaggtgatccagatagagccctattacctgaaggccgagaagaagttcggctttctggtggacttcgcatttaagaaggccaaggacgtgccctatagcatcagggttcagcagctgagcctgtcactgaacaagtatgggaagagcaacgccgactactatagcgacaagctggataagataaagttctttatgcagaagtttaagcagaggcttttcccatttagcttggataacgaggattacgacatcgagaacgagctgtatctgatgaggagctacccgctcaagatgaagacctacatattctctaatggcaaggaaagcaacagccaggtgcagggtctcaaaacctacggaccgctggcgaatctcgataaggagccactgttcgtgttcatgttcgagtcccaggacaggaacgaggccctggagctctattctagcctgctgggcaagacgtacaccaacatatttgctggcatggagagcgtgtacaaaatcaaactcgcaaaagagaatgtgaagcacatcatcatccccagccttaccaaggagggtctgcaagtggtggagcaagagctgcaaactatcgtggagagtcatcaggacaagaaggtgattgggatatttgtaatgaatgaaaaggtgccctcatccatcaccggtttcagcccctaccactacgtcaagtacatcttcacagagaaacgcattcccctccagacagtgaggtgcgagaggatcgctgccagggatggcctcaaatggagcgttggcaacatcggcctccaaattttcgctaaattgggcggcatcccctggaaagtcaagccgagtaacgataagtgcatcatttttggcctgggctgcgcccacaaaaaagacgaactgggaaacattaacaaatacttcgcctacagcgtgtgcatggacagcagcggcatttaccgaaagattaatgtgctcggcgatgcaaaggagcgcactgattacatccttcaactgcgggagaacatcaaaagcgtgataagcgagaatctggacgggagcattgaaaagtgcgtgattcacctgcccttcaaaattaagaacgacgagatcaggtacataaaatccagcgtgcaggagatcgcgcacctgtattccgacatagaatttcaatttatcaagatcaacacggacaacaagtttttcggatacgctgaaaacaacagcaaggtaccctacgagagcagctacatacaactgagcagcaacgagttcctggtgtggttcgaaggcctgcagtacgggaaggagctggtgaagaaaaaggtaggtaaccccgtgcacattgagttcatgcagatcgatgagttggatcccgaaaagaagcggcgatatctgcaggatatcataaacctgagcggtgccaactggcgaggttttaacgccaaactgtctccaatcagcatctactaccccaacatcatagccaatttcatttcagagttcagggagttccagcccgaaggcgacgtggacctgaccaacttttacattccctggttcctg

SEQ ID NO: 238 - DNA, 2769 bp, Artificial Sequence
  Description of Artificial Sequence: Synthetic polynucleotide
atgcataacatcgaaatcaacaccttcgtcaacagctttgccattaaacccaacaactccatgtccttcctgctcggcgcaggcgcgtctatatcctccgggatcctgtctggcggacagatggtgtgggactttaaacggaacctctattgtgcgtccaaaaacatacgcaccagcaattttcccgatatgagcaaaaagaatgcgcaggacgagatccaacgcttttttgatgggcaggccggaaatcctagcctgtggtcctccgaggagtatagtttctacttcgagaggtgttatccggcgaggaaagacagggagctgtacatacagaacaaggtacgagacgtcaagccgtcattggggtatctctgcctcggggaattgatcatacacgagaagatcggtgtagtatcaaccacaaactttgatgacctggtgttggccggcatccattcaataagaccggacctgagtgtgaagaccatcagcagtgccctcaaaaatagcacgggattcttcgtgaacgacgggttcccgaacatcattaagctgcacggcgattacttgtacgataagctgaagaataccgataaggagctgcaaaagctcgagacggagatcagcggaatttttcgagatgccgtcaagagtggcgggctcatcgtacttggctacgccggcaacgacaacagcgtgatgagcgtcctggaggagctcgtaagctccgggcaaatcaggtacggcgtgttctggtgccaaccgaagggcttccccctgtccaagcgagcgcgggagtttattgagaaggcttgcgcctacaatgaggaatccggggttgtcgagatcaacaattttgacgactttatgtaccgcctgttccttacactcaacatccaaaactcatttatcgacagcatgtgggaacagagcggcatgaagcagccgatcctctatgagaatatcggacgacacaagtccaccgccgtgacgaacgccctgtgcgccctgcagtacccccgaaaatgctacgtcttcaacgcgaatatatcaagctggaaggaactgcgcgagacgataaacgacacgtgcgtggcagtgctgtataagggcatggtttgggcgctgggcagcaaagcaggcatcgtgcatgcgttcgccgggaagatcaatggagacatatacgaactcgacatcccgttgtacatgatgaaactcgaggattctgacatcctgggcatgttttacgacatcataggacgcggccttcagcgaaaggggctggtgagctacggtaataggaaacatcacaaatacttcaacccctccagcaaacggttcaagaacggtcaaaacatctacgacgcggtcaagatatcactgagtttcgtggacgatcagctcgtgctcatcctgctgcctacggtgcatctgctgaaacgcgacgggacggagctggagaaatttgactaccaaaaattggtgtcccaggagatggcaacacactacaacaaagtggtggacagcgagatagagatctggctgaaattcatctctaataacggcaagataatctttgagctggggaacgcaatactggaatttaacaacgtccgcatccagtactctggtaacggtaacctcagcaagtgctaccaggtgagcgagcccgagctcacgttcagttacgaaaaggacaactgcatcgctaccaaccaactgcggggtctgatcaactatggacccatagagacttacgtgaacaaagccatcaggttggctgtactcagccctaaggagtgtgccgcggacatttggaaacacctgcagaagttgaatgagcatcacgtcacctcccttattcaggatgcaaattttctgccggagtacaccggctttcagaacgtttttaggtgcaaccttgacattcccaatgggaacgatgtgcataggttcaaaggctacagtatagacaaggtcatgcaactcaacgcaaagagctacttttacgggatctgcaagtacattgatgcattcgagacacaaaggagccaatacgacctcctcgtcatctatatacctaagcagttgacccacatccgagaggccaagaataacttcgaatatttcgacctgcacgacagcctgaagatttattgcgctggtaaaggtatagtcacgcagatcatcgaggaacacagtgtttatactaacaatgacaccgccaagatcatatggggtctctcaacggccatattcaccaagaccgccggaaggttgtggaaacccagacgctattccatgaacaccgcttacgtcggcctgtcatatgtgcagagcgttaagaacaacgagaaagtcagcatcggttgcagtcagctgttcgacgccgaaggcaatggaatgaagctttacctgagacccttgatgaacccccagataattcaaaataacccttttatgcggagcgacgacgcttgcaggcttatgtcaaaccttaagcggatgtatgacgacagtgtcccgctctacaaactgaataggatcgtgatccacaaaactacgttcttcactaaagaagagatggaaggcatcaccaaagggctggctggagtggatgacatagagttgctccagatccaggagttcacagcttggcgagcaatacgcttcgactacgacaagatcgcaccgtttccgatacagaggggcacagtgattctggggtggggccactttagttacttggatacctggaagtgtaccacc

SEQ ID NO: 239 - DNA, 2289 bp, Artificial Sequence
  Description of Artificial Sequence: Synthetic polynucleotide
atgaacgccgtgaccgtgggcagcaccccaagcgcccaggtactcgtcggtgttcagccatacgacgaaaccaccctggagagcctgagaagtaaacaccgcggagactatctctttaaaagggggggagagaacggcgatagcatacttgctgtggccctgaaaccgagtctgccggtcatcggagcaaccgaggaggatgtaattcttgccgagagcccatggttgttggctccacttgccttggagactttgctgcaatgcttcgtgaggcttcaaaggcccatcctgaaagctaggcatcccctgagagtgctctcacaaaaaccggcaaatcttttcccagccgatgcgggggtcccccagtggctgcagaggagactggtgctggaattcgacacgcgcactgttagggacaggtcagacgctgcctctgtcgtgctggcatgtggcgtgaggactcggaatttgattgatgccgactgcgcgacactgatagcagccggtgtcccccttgtgaatcgatacgtggtgacgaggcaccctgcggatgatccccgagtgcagggctatttgaggctcgccgggagggtgaccaggatagatggccccaacctgtacttggaggatcatggcgatggagcagctgtgatcaaggcctccatggcctatctggagcccaggagggagaacgtgatttggtgtgcccaccatttgctggggagaaatgcggatagagtactggcggaagcggataacgcagccgcaaagcacttgagcggtcccgaacgattggccgtagtgaagaagactttcgactaccttaggagccagaacatcgagcttgcgcctggagtgcccctcactctgggtaacgttgtggggaatgacaagggttcttggatcttccggacggaaactctgcccaagccccacctggtgttcgacccgagcgggacccggatcgataggtggaatgagaggggattggacgctcacgggccctatgatcaaaggaccttcacccctaaacaactgaggattgccgtcatatgtcaactgccctacgaaggccaggtcgatgcgttcctggcaaaatttctcgacggccttccagacgtgaagaccggctacggggaccgggccagggcgccttatgccaaggggttcatcaggaggtacggtctggagaagcccaaggtgagcaccttcgcaacaaaaggcgctactgctaaggactatgccgctgcatgtagggcggctgtggaggacgcaaccgcaagcggcttcgagtggaatctggctatcgtgcagatcgacaaggatttcaaggagctgagtgacgtggagaatccctacttcaccaccaaggccctgctgctgaagcatcgggtgcccgtccaagaggtgacgctggagacgatgaggttggcagacgaacagctggtgtacgtgttgaacaacatgagcgtagccacctacgccaaagtgggcggtactccctggctcttgaaagcgcaaccaaccgtggcccatgagttggtagttggaatcggaagccagacttttagtgcctcaaggctgggtgagaaagagagggttgtaggccttaccaccgtgttctcctccgacgggaaatacctgctggacgaccggactagcgccgttgattacgacaactatagcgaagagctgtttaagagcttgtcccggtcaatagaatcagtaaggatcgccgataactggcgaagtacggacagtgtcaggctgattttccatgttttcaagcagatggcggacgaggaagccgacgcggttgacaagttggtgcaaaagctgggtttggcacaggttaagttcgcgtttctgcacatcgtggatgaccacccattcgccctgtttgacgagaagaacataggtacaaagacatggggtgggatattcaagggcgtcttggcaccggaaaggggcctcgcggtaaacctctctggggccgaaaccctgttgtgcttcacaggcggcagggaactgaaacaggcgaaggatggcctgcccgtgcctagtctgctgcgactgcaccacaggagtacgttcagggacatgacctacctgacggggcaagccttcaacttcagctgtcacacctggcgcatgttcacacccgctcctgttcccatcacaatacattacagcgagctgatggcgcgactccttacgggcctcaggcacgtcccggattgggatccagacacaatgctgacccccatcagtcgaacccggtggttcctg

SEQ ID NO: 240 - DNA, 2106 bp, Artificial Sequence
  Description of Artificial Sequence: Synthetic polynucleotide
ctggacagtttccacctcgtgcagacagagaaaaaggccatcgcaatgccaaagcagaagcttgcggttaatgcactccccattagcctgaaagagcaggagcagcacaagctgttcttttttagcaaggaaaagcagggcgagcgagccccgctcaccaggaaagaatatcctgacagcttcgccaagaggtaccccaagagctccaaagagtacgacgtgctgtacacggacttcaccccagagccagctgaggatgggtttgaaattgatatcgacctggaggaggcacctggccttgccaagcactacttgcacaaaaggatctttgaggcctttaagggagtagctgacttcagaaagcgggatttcatcaacggtgtggagctttggttcagggacaaacccgccgacgaagttaatttccgggcctacaagaagtttaagattaccacccgcagaacttggttctccgcaggctgggccctgttcatacaatacaccggccattcctttattcacccggtggcgatcaatagcgaagaggccgcagtggacactacggaactcacgcgggttgcttataaccgacacatcttccactacgaggagatccccgaagacaaactgagtgagatagatttcagtaagatgtaccccgtggtgaacttcaacattagggataaaatgcagcagttccccgttatcgatccattcaaaaacaaggtcaaggaatatgtcgacgaaatagacaggttcaagaacatgtatctgatcgcgccagcggttgaggaggtgcttccgtttactttcaacgacgacaactggtgcgagatcaagatcggcacctaccataccgtgcccaatgccggttccaaattggttttccgcgatgggcaaaccgagatacacccgttctacggtatcaggaaccacggccctttcatgccccccaaacacagccacataaggtttttgtttatcatgagcaagagggacatcaagggcgctggtaagcaattctatgaatacttgaagggggaggtaaaaggagtggacgggttcaacaggtatgctaatataccgtcatccctgaggggtgagatgatcgagtttgagaacgagcaaaaccccctgccggagattatcgacggcttgaacaacatggagcgagaagcgggcgtggcctacttcgccttctatatcagccccatcgaccgagaagtgaggaacaggaaggagaggttggtgtactacagggttaaggaggagctgctgaagagaaagattgcctcacaagtggtagaaaggagcactatcgagaaggccgacttccgctacagcatccccaacatcgccgttgccacagtggccaagctgggaggcatcccgtggaagcttactcaacccccagaagcagagctgatcgtgggcataggcgcattccagccacgcgagttcgacaagcgatatctgggcagcgccttttgcttccaaggcgacggaacctttagcggcctgaggtgtttcaccaaggacgaaccccatatgcttgctggcagcatcagggaagcggttcaaaggtacgccgatgaaaacaggcaagtggaacggctggttatccatttctacaaaaccatgagctatgacgagaggaagccgatcctggccaccttgaaagaactcggcctggacattcccgttgtggtggtcactatcaacaagactgaatacgagcagacaatcctctttgacctgaattctagcatgaggctgccgctgagtggtacctatttcagccagcgcagggacgacatcctgctgagcaacaacaccaggtaccgcaaagacagcgaggtgaagaggggtttcccttttcccgtgagactgcagctgtggtgctccaaggagggcctgctggacgacgagggttttagggagcgactgatcacccaagtgtataggttttctcggctttactggaagagcgtgtctcaacagaatctgcccgtgaccattaagtatcccgagatgctggccgaaaagttcccatactttaactcaaggagccttcctagcttcggcgaaaaaagcctgtggttcttg

SEQ ID NO: 241 - DNA, 3012 bp, Artificial Sequence
  Description of Artificial Sequence: Synthetic polynucleotide
atgcttatctggcaattcaagagaatgctctactgccaggccaacaacatcaaagaggaaaaattcaaagacctggagagcgagcgaaatcaaaacactatccagagctattttgacctgaagggcggctatccggaaagatatagccaggaggaatactccgcttatttcgagcattgcttcccgaagtctatcaaccggaagtatttcatgcagaaaatagtagagggccgaaatccgagcataggtcacaagtgtttgggtgccctgttcgactgcaaaaaggtaaaccacatctggacaaccaacttcgacgagctcatcgagaatgggattaaaagcgtcaacaatgccagcagcttcgaggtcattagtatcgacaatcagaggcagctggccaacctcaacaactacccaagggtggtaaaacttcacggcgactacaggtacgacaagctccaaaataccgttgacgaactgcagacgctggagaaggacctccataagtacttcgccgatgtgcaaagcaagaccggcttgattgtgataggctacggcggaaacgaccagagcatcatgtccgcctttgaaaagactttggaggccgacaacccgttcccgtttgggctttactggtgcgtgaggacgggccagaaaaccaacaagaaggtaatcgaattcatagagaaggttcaccagaagaacaaggaaaagcttgctgcgttcatcgaaatcgactcttttgacgattttctttatgagctgtataagacgaacaaccttgccaacgatcacattgaaaatatcgccaaaagccgcttcgaaaaaaggaaggcttttacagccccccagatcggcacctcctttacgcctataaagcttaacgccataaaggccaagacttacccgaaaagcatctattcctttaaaactgacctcaaggggggcaaggatgactgggataaactcagggaaatcattaaggaccaaccggtgagcgcggctctgaccaatgaaaacacggtcgccttcgcaagtgtcaacgacatcaagaaactcttctcacacacactgaagtcagagatcaccaccgtggacatagatgacaagttgatctatcggcaggagtctttctacctgggcatgctttacgatctgatagagcacaacctcctgaagaagttcaagttggagaaagtgcccaacaataggctccgcaagtattatagcaaaaactacaagctgaataccgaggagcttcagaagtccaagatcaagaccagcctgtccgtctacgaagcgttcgagattcaaatagaattccacaataaagagctgttcctcattatccttccgtccatccacatagacgacaaagccgggctgagccgatttgagaaacaggagatagccaataagatcataagcaaaaggtggaaccgcatggttaacaaccagcttaggttctggctggggctccttaagaacgataacactaacatagagttcagcatcgacagtttcaagattgatttggaagaaaagttctccggcgtcgggagctttacatcctcttactacatctttaagggcgcgtttatttccaacgaacccaagcttagcttccatatctccgacagcaattacaaaacagtgcaccccctgaaaggcctcaagaacttcggtccactggattactcatttgaaagcaaacagaccaatcagcaggctattaaacttggtataatcactccgatcagcggcatgcaacggatactcaaacacctgaacgaacttaataacgagatccgcgcagctacggaaaaggagtacctgaccgattattacccctttagcaacatctacaagagataccttgacatcccgcagaataaggatagtaaattcttggaactcgtgaatgaagccgaagtgaacaaactgaaccacctcgagttttatgacttcctcaaacgcaaaattgattacttctatacaattaggggcgagttcgacgtgcttgtgttgtattttcccaaaggctggactaagttccgcgagctgaaaaatgacagtgtctactttgatctgcacgactccatcaagctgtactgtgctaagaagaatatcaagatccaattcgtggaagataagagtatagactacctcgacccggccaaggttaaatggtggttgagcctcggcttgtatgtcaaagcgaacgggctgccctggcggaacgtggtcgtaaacgaaagcaccgcgtttgtcgggctcgacttcgcggtccagcgaataaacaacagtaacaagtacgtgctgggtagctcacagatcttcgacagctccggacaaggactcaggtttctgttgcagcccatcgaacaccctgtgtttatcggtaaaaaccccttcatgagcaaggaagatgcgcgacggatgattcttaaattgaaggaagcgtattttaggattgacggtaactccaagctggaaaaactggtggtgcacaaagtactgcattacacaaatgatgagatgaccggcatttccgaggcgctggaaggtattgagaacattgagcttctgcaaatacagaagtatagtaagtggagggcaattagaggggacatcgatcggtatacgggaaaggtgaagaccgacccgcacaatttcccgatccaacgggggacagtgatccagctcgacgacttctctttccttctgtggacacatggaagtgtacaggaagacgacgtggctggtaggcacatgaattactaccagggtaagcgcgggattcccgcaccacttctcatacggaggtttcgcggcaccgatccgattgaaatgaccgtgcgagacatcctgtcactcaccaagatgaactggaacggaggcgaactttacaagactctgccggtgaccctggatttctctaaacggctttctaagtatgcgaagcaggcagagaccctccaggcaataccctacgactttcggttcttcatg

SEQ ID NO: 242 - DNA, 2274 bp, Artificial Sequence
  Description of Artificial Sequence: Synthetic polynucleotide
atgcttcaactgaacggctttagcatcgaaatcgccggaggttccctgactgtcttgaaatctaaaatcgcgcctaccgacgttaaagaaacccgcaggagcctggaagacgactggttcaccatgtatcacgagggccacttgtactcacttgcaaaaaacagcaacgcatccggcggattgggtgagaccgagctcctggtcctgtctgatcatctgggtcttaggttcgttaaggctatgttggaccaagccatgaggggcgtattcgaggcctacgaccccgttagagataggcccttcacatttctggcgcgaaacgtagatctcgtagccctcgcggcagaaaacctcgagtccaagcccagccttctctccaaattcgagatcaggcccaagtacgaactggaggccaaggtagtggaattcagaccgggcgagctggaacttatgctggcgctcaatctgactacacggtggatctgcaacgcctccgtagacgagctcattgagaagaacataccggtccgaggaatgcacctgatccgacggaaccgggagccgggacagagaagcttggttggcaccttcgaccgcatggaaggcgacaacgccctgctgcaggatgcttacgacggacaagacaagatagcagcctcacaggtgaggatcgaggggagcaaggaagtcttcgcgacctctctgaggaggctcttgggcaatcgctataccagtttcatgcactccgtggataacgagtacggcaagttgtgcgggggtttggggttcgacggcgaacttaggaagatgcagggatttctcgcgaaaaagagtcctatacaactgcacggaggtgtagaagtgtccgtggggcagagggtacaacttaccaatcagcctgggtataagacaacagttgagcttttgcagtcaaagtactgctttgacagaagtaggacgaagctccacccctacgcctgggacgggcttgctcgattcggcccattcgacaggggcagcttcccgacgcgatcccccaggattctgctcgtgacacccgactccgcgagcggtaaggtctctcaagctctgaagaaattccgcgacgggttcggcagcagccagagcagcatgtatgacggcttcctcgacacctttcacctcagtaatgctcctttcttcccccttcccgtgaagctggacggcgtgcagcgcagcgacgtgggcaaagcttatcgaaaggcgatcgaagataaactcgcacgagacgacgacttcgacgccgcctttaacattctcctggacgagcacgccaatctgccggacagccataacccctatctggtcgccaagtccatcctcctctcccacggcatcccagtgcaagaagcacgagtgagcactctgacggccaacgaatacagcctgcaacacaccttcaggaatgtcgccacagccctgtacgccaaaatgggtggtgtcccatggaccgttgaccacggggagaccgtggacgatgagctggtagtaggaatcggaaacgcggagcttagcgggagcaggttcgagaaaagacagaggcacatcggaatcacgacagtgtttaggggggacggcaactacctgcttagcaacctcagcaaagagtgccgatacgaggattacccggacgtactccgggagagtaccatcgccgtgttgagggaggttaagcaaaggaacaattggttgccgggtcaaaccgtgcgaatcgttttccacgccttcaagcctctgaaaaacgtggagattgccgacatcatcgcgagctctgtaaaggaggtaggctccgaacagaccatagaatttgcattcttgaatgtttccctcgaccactccttcacccttctggacatggctcaaaggggaataacgaagaagaatcagaccaaggggatatacgttcccaggaggggcatgacagtccaggttgggcgctacaccaggcttgtaaccagcatcggtccgcacatggtaaaaagggcaaaccttgccctcccgcgacccctgttgattcacctgcacaagcagagcacctatcgggacctgagctatctgagcgaacaggttctgaactttaccaccctgtcctggaggagcaccctccccagcgagaagcctgttaccattctctactcatcactgatagccgacttgttgggaaggctcaagtcagtggatgattggagccccgcagtgttgaataccaaactgaggaatagcaaatggttcctg

SEQ ID NO: 243 - DNA, 3051 bp, Artificial Sequence
  Description of Artificial Sequence: Synthetic polynucleotide
ctgggagccggtgccagcatcagttccggcatccaaagcgctaatgactgcatttgggactggaagtactctatctaccaaactaactccggcagtcaacgagtggccctcgtggaccctaagaaatccgacgcctccaagtctatcatccagaagtggctggataatcaaccgaaattctcacagatcgaagcccatcaggagtacagcttctacgcccaggcggcttaccccattgaggcggaccgaatcaaatactttcagaatctcttccaggggaagtccccctatatcggctacaaattgctctgcctgctgaacaagtacggtgtagtgaaatctgtgtggagtaccaacttcgacggcctggtcgaacgggcagcacagcaagccaacatcaccctgatcgccatcaatcttgactgtgttgaccgcatatatcgagcagaaagcgtgaatgaacttctgtatatcgcgctccacggggactacaagtttagtaccataaagaataccgcgaatgagctcgacagccagcacaccgagttcgtatctgccatgtgccggtacttcgtcgataaaaacttgatcgtcatgggatacagcggacgcgacaagtcacttatggacgccctggtccaagcgtttagcaagaagggtggggggagactttattggtgcggcatgggcgagaccatcacgatcgaggtgcaaaacctgatacagagagtgaggaccgcaggccggtcagcttattatgtagatacctctgggtttgacaacaccatgctgtcactggtaaagtactgtttttcagaggacgtcgccaaacagcgagaaataaacgaaattttgaaaattgtggaaccggagcagattactccgtttgagattcaaaagagccagaacaaacggtatctcaagagcaacctgctgccaatcgtgcttcccaaggaactctttcagtttcagatctcttataacgacacggcggacaggtggggattcttgcgcgagaggattaaggagcgggaaatcatagcagtcccgtaccaggacaaagtatacgcaatcagcacggtctccatcattaacgacgttttcaaggactgtctcgtaagcgagattgagcgcacgtccatctctctgaatgagatcgagcgcaatggctgcttcaaagagctgttcctcaaggctattctctacgggtttagccaaatccggaatctgggcatcaactaccgccacggcatcatttggaagaaggaggcgctctacactgagcccggcaagaccgtacacgaggccatagaatgcggcttgtcttttataccgcaagcgaactacgctttgattagcatcacaccaagtttgcacatcgaatccagcagcccgatcgaaaaagagaagaaacaagagtataacaggcggtaccttgacaagatgaggaataaagagtacgaggaaaagatccaggagtggtgcaacatactgttctccggtaacaagctcgtttttgacatcccgctgcaaagcaacaacgacttgaagttcttcatttccagtaataggggtttcgccgaggtatacaattacggtaaggacatcgagaagagctacacgcccaatgcttacaatacgaaacagaccatttactacggcatgcaaatcgaagagcctcagttggagtttatcaactccataatcagtaggccgttctatgacgttaacccaatgaggggcctctcaaatcacaaaccattcgacgcggactactatgacaagttcccccaggatgtgtgtttgggcattgtgtgtccgaccagctacagcctgatgttctcagaattcctgaagcgcctgaacactaagatcccagcaccgaagtcatccgactacatccacaactatattggctttaacagcatctacaactgcaggctggacataccggacatcaatgccgatcgctgggtgagcatcggcgacaacccccagaacgcggaggaattggcccgcaacatctgtatggaagcaaaaaagctgagtgaacaatatccgggcatcgtggttaacatattcatccctactatctggagcaactacagaaactttaaacacaacggtgaattcttcgacctgcataactacattaaagcatttgcggcacaaaatcgcttcaccacgcaactcatcgaggagaaaactgtttgtaacacgatgatgtgcgagatatcctggtggctttcccttgcccttttcgttaagaccctgaggactccgtggacactggctgaccttaaccccaacaccgcctacgcggggatagggtattcagttaaaaagcaggccaagggcaggacagagatcgtactggggtgtagccacatttacaatgcgcagggacagggactcaagtacaaactgagcaaggtcgagcacccacagttcgacaaaaaacggaacccattcttgagcttcgaggaagccttcaaattcgggatggatattcttaatttgttccagagtgcaatggaaaaactgccgcagagggtggttattcataaacggacgccttttagggaagaggaaatagaagggattaccagcgccctcaagcgggcagggatcacggaggtggacctgatcactataacgcaggagcgaaacattaagtttatagcacaggttgtctccttcggccaactcaataccgacggctatcccgtcaacagaggcacttgcatcaagcttagctctcgcaatgcactcctttggacccacggcgtcgtccagagcattcgagacaaaagacggtactaccaggggggcaggtgcattccgagcccgctgaaaatcactaagtattacggcaacggcgatctccagactatagctaaggagatcatcggtttcacgaagatgaattggaatagcttcaacttctatacgaagctgccagcgaccattgacactagcaacaccctggcccaagtgggcaaccttctcaggaactataatggcaccacctacgattatcgctactttatc

SEQ ID NO: 244 - DNA, 2097 bp, Artificial Sequence
  Description of Artificial Sequence: Synthetic polynucleotide
atggccaaccatacctttaacatcctgactttcaaccacccccaggaggaacagaccttctacttcacggaccaggagcaagacaacctgacccgcatctacaagagcctggtgcccgacgaggtcatcgagaaatatggcgagcaggatcactactacacctctttcaccgtagagaaggatggtttcctggccgtcagcaagcccacaacgcccctgttcgagaccaagactacggaggcgggcgaggagaggagctataccatcaggaattcaacgttcagcagcagcgtgttgaaacggtactacaacagccttatccacagccacttcaaggagaagggcttcctggtgaagcccaacttcgtgagcgacacggaggtgtggctgcctagcgccaagcaggacacgaccggcaaatacaaaatattcgaccgctttagcctgaaggtgcagttcaagaccgtctctgattccctggagttgctcgtcacgttcgaggggaagtcaaagatattcaaagtacctgttagcaccctgctggaggatgtgagccccacggacatcaactgggttgtgtacgaaaagggattgtacaggttcgacgaactcccggacagcggcaagagggagtatgacaaggtttaccccgtgtggaccttcgagatcagggacgcgcttatgcagggcaccgaagccccagacaagaccaacaagtacaaaaagttcagggagggcatcgacaagttctataaccagtatctgaacacagaggagttcaaagccatcattccaatcacgtctaatggcttcatcccggtcaataagatcaatgtcggtagtgtgaataatagtagcaacaggctgctgttcggggaacaaaagagcggtatcgtgccaatggacggcatgaaggaacatggcccattcgacttttccagcaccagcaagatccatttcttctttatctttcataaagacgaccagcacatcgcccaaaagatggatggctatttcaaaggcagcgagttcgggttcaagggactcaccaaattcatacacaccccctatcacaccgagaaaggattctcaatcaggtttgaggaccgcgacaatccgtggcccgagatctacgaagccgtcactaacaagcacttcgagtccgacatacaatacattgcgatctacatcagccccttcagcaaaaacagccccgacaagagtcggcgcaaaatctattacaagctcaaagaactgctcttgaaagaaggcgtgagcagccaggtgattgacggcgagaaggtgatgaccaacgagaagtattactacagcctccccaacatagcaatcgccattctggccaagttgaatggcaccccttggaaactggacaccaagctgaagaacgaactgatcgtgggaatcggcgccttccgcaacagcgaggttgacattcaatatatcggcagcgcgttctctttcgcaaacaacggcaagtttaatcgctttgagtgcttccagaaggaccagacgaaagaattggcgggaagcatcatacgggcggtgaaggagtacgccaacgtaaacaccggcattaagaggcttgtgatccacttttacaaaagcatgcgacaggatgagctccagccgatcgaggacggccttaaagacctcggcctggacattccggtattcatcgtatctatcaataaaacagaaagcagtgatatcgtggcgttcgataacagctggaaggatctgatgccgatgagcggcacattcattaaagtggggtacaacaaatttctcctgttcaacaacaccaggtataatccaaagttttacagcttccacgacgggttccccttccccatcaaacttaagattttttgcactgaaaaggaactcgtggaggagtataaaacggttaaagagctgatcgaccaggtgtaccaatttagccgcatgtactggaagtctgtccgccagcagaacctgcccgtgaccattaagtatccggaaatggtggccgaaatgttgcctcactttgacgggaatgagatacctgaattcggtaaggacaacttgtggttcctg

SEQ ID NO: 245 - DNA, 2130 bp, Artificial Sequence; identical to SEQ ID NO: 193
  Description of Artificial Sequence: Synthetic polynucleotide

SEQ ID NO: 246 - DNA, 2217 bp, Artificial Sequence
  Description of Artificial Sequence: Synthetic polynucleotide
atggagaacctggctcttagtgcgctgcaactggactctaagctcgaccgctacatcgtgtgcaggtacagaatcgtgtaccagaagcgagacgagaccattcccggcgaacagttggcccggaaggcggcctacgagatccagaaagcgaatgacttcgcccttttgaccaacctcggcaatcaacacatcgtttccctcaagcccatctcacagaggggcattgaaagcacccaccttcaggcgaatctcatcgaagacggggacctggagctcgattgctccatcgaacaacatcagcaggcactccagcggctcgtgaaccaggacatcaataaagctgcgtggaagcttaagaagagctcacagggcaaactcgattacaaaaaggcagctagcgggaacaccgagatctttgagccaattcatagcactcgaatcaacgcccgagccacgtatcttgacgctttttgctcactgcagcttagccccgaggtgcttgctaatggaaccgtactgatagggctgcatctcaagcacaatctggtagcaaagtctgacatctctttgcagtggatcattgataaaaggcccgattggctgcagagcatcaagaaggtgcggcacaggtacttcgatcccggcaaagcgcccctggtcgccgaattcctgagggtggaggactccctgaatggcaacagcgtcttgccccacatgggccagagtcttgtttcataccaccaagcgaagggactcttgtcagaaagacagctcgcagaggccacgaagagcgtgctgataaaggtaaaatacggcaaaaacgaggcggaccacatcgcatctctggttgaaccaatgtttgatttcgacacgctcagcaagatcgatagtatcttccttaacaagttggcaaaggacctgaagtggagcctgaacgacaggatacgcacttccgcgaaaatggtgaaaggcttgtatctcccaaacttcaactgcaagctggaacaggttgactatcagatccttcacaggcagcgacttaatcaccaacagatgcttcaattcgccaacggggcgaaatcttcaagagagcaggacgtgctgcgacataaggcgttcggcaacatgacgcgcacacaagttatcccgcttattgcgggcgagaagaacaatacagaacaaaataagcagctcctgtgcaacgcataccaagcattgcaacaactgaccaccacggaattgcctccgttcaccaagttccccaaccccgtagagaacgcagccgagctggacgcaagactgaatgaacggtgtcccccaaatgcgatactgctcatcggccttatcgacaaaagcgacaaagtggcgatccgcgacaccgcgtttagctacggtcttgcaacccagttcatgcgcctggatcacagaccgaacgtctacagcccctcatatttcaacaacgtggcggctggtttgttttccaaaggtggcgggcagctctgcgccattgatgacatgccgggtgaaaccgacttgtttatcggtctcgacatgggagggatctctgtaagggcaccaggcttcgcgtttctgtttctgcgatctggtgcgcagttggggtggcaactcgcggacaaacaacagggagaaaggatgcaggatgaggccctgatgtcactgttggacaagtctctcaccacctacctgagaagctgctctggtgagcttcctaagcgcataaccctccatagggatggcaagttctacgaaagcatagaagtgatcgagcagtttgagcagaagcacggcgtgaaagtagatgtgctggaggttctgaaaagcggtgctccggttttgtatagacgaagccgcatggccgacggaaccaaggagtttagcaaccccaatgtgggcgacgcgatctatctcagtgatcatgagatgatcctgagcacgtatagcggcgaagaactcggaaagatatggggtgacaaggtcagcgtcaggcctcttaggctgcgcaagagatacggtgatgtgagcctggagaccctggcacatcaagtgctcgtgctgtctaggatacacggcgctagcctgtatcgccatcctcgactgcccgtgaccacgcaccacgccgaccgattcgcaacactgaggcaggaaacatgcatagacgccctctctaagatggaccggctctgtccggtctacctg

SEQ ID NO: 247 - DNA, 2289 bp, Artificial Sequence
  Description of Artificial Sequence: Synthetic polynucleotide
atgcagctgaactacttccccataaagtttgagtttgaagagtaccagataaaaactgagccctacagcgaagaacgacttaaagagttgagggccagttacaacgccacccactccttttttagaaatggagacaatatatgcattagcaacaaggaaggcgaggacattagtctgaccggcgaggtgataccgaaaagaattttcgacgacagtcaagtgaccgcctcattgataaagcacttgtttttcaggacgttcaaggagaggttccccaactatattcctgtggacttttaccccttccgcttcttctccgcccaggctaaagacgacatcatctataacgccctgcccggcaacctccggaaacgaatcgcttacaaaaagctgatcgaggttcagttgcggctgacggaaataaacggcatcaagcagtttggcttcctgatcaacattaaacgaaattgggtgttcaacaagtcatgcttcgagctccactccgagggctacaacctgatcggggtggacgtgctgtacgccgaggaactgccggggttgaccgaggtgctggccccaaacgaagagcttttgggcgtaatcgcggaaatcgtggacgacaatgccaggatagaaaccaacgagggcattaaggagttccctctgaaccagttgttcatcaagaaaagcaagtacaacattggcaattaccttagcttcgcgatctctcagcaaaagagcgacgaaataatgaatcttatcgagagcaaacgctccgacatctacaataccaagggtctttacgacgagatcttgaaaattgcgaaccatcttttttgcgagaacagcgcacccatactgtttcataataaggacggattctgctttactgtcgattcccagccgctcagtgtgacgaacagcatggaattgaagactccaacattcatatacgatccagcggccacgaagacgaattctagcaatcccgacttgggcctgtccaattacgggccctacgactccagcatttttgacataaagatacccaacgtgttgtgcatctgcaataggaataatcgaggcaactttacaaagtttctgtctaacctgaaagacgggatacctcaaagccgctatttccagaaaggcctccagaagaaatacgacctccaggatgtgatcctcaatatccgagaaatccaggcctatagcatcgccgactaccttaacgccatcagggactacgatgagaacaagcctcatctggcgatcatcgagatccctgccagcttcaagaggcaggccgacgtggcgaacccctactaccaaattaaggccaagttgttgagcctggagattcccgtgcaattcgttaccagcgagaccatcggtaaccacaacgagtatatcctgaactctatcgcgctgcagatctacgcaaagctcggcgggaccccgtgggtcctgccctctcaacgcagcgttgacaaagagataatcatcggaataggccattcctggcttaggcgcaaccagtacgctggcgcagaacagaatagggtagtggggatcacgacctttatgagctccgatggccagtaccttctgggtgacaaggtcaaagatgttgccttcgagaactattttgaggagcttctgaaaagcctgaagcaaagcatccagaggctcagcacagagcagggctggagcgatggcgacaccgtgaggctgatattccacatattcaaaccgataaagaacactgaattcgacgtgatcagtcagcttgtcagagacatcacgcagtacaagattaagttcgcattcgtaaccatcagcactgtgcacccttccatgttgttcgacattaatcagtccggtatcgccaaatacggttccaatatcatgaagggacaatacataccaaacaggggcagcaacgttttcctggacgagaagacatgcatcgtacagatgttcggcgcgaacgaactgaaaacggccaagcaaggcatgagcaagcccatccttataaacattcgcaccccccaggggaactacaattcaagcgacctgaacgatctcctgttttatgacctggggtacatcacacaacagatatttagctttacctacctcagctggcggtccttcttgcccggtgaagagccggcgactatgaagtacagtaacctcatttccaaacttctcgggaagatgcggaacatccctaactgggacgccgacaatcttaactacggcctgaaacggaaaaagtggttcctg

SEQ ID NO: 248 - DNA, 2022 bp, Artificial Sequence
  Description of Artificial Sequence: Synthetic polynucleotide
ctgaagctgaaccacttcccccttaatcccgacctccccctgtacatcacagaatatgcccaccggaacccgcgagcgttgctcggattcgttaggggccaaggtttctgggcgcaacaggtcggagaacaggtacaagtgtaccacggtagaccgcagcccacgttcaggggagttcaggtgatcagccataccaggttggaccccgaccatccggcttttgaccaaggcgttttgagcctcatccgacaagcactggtgagggcgggatacgtgctgacctacagggagaggatggctattcatcccagactggagagggttgtgctgagacccccggaccggcacccagcagagttgaccgtccatgcacatctgcgatgggaatgggagcttgaaaggcacagcggacaacgctggctggttcttcgacccggcaggcgacatctgagcgcccttccatggcccgcagaagcagtacaaatgtggtccgccgctcttccggccacctgccagaagctgcacgccctttgtctggaccgaggccaacagatggcccttttgcggcaagaggacggctggcacttcgccaatcccggtgctgccactcaaggaaggtggcacctgtcctttagcccccaggcccttcacgagctgggactggcacaggctgcgcaccatgcggctgcatttaggtgggacgaggtacagcgactcgtgcaactgactgacctgtggaagcccttcgtgacctctctggagccccttgaggtagctgcccccatcattgccgggaaaaggctgaggtttggacggggtcttggccgcgatgtcacggaggtgcacaagcgaggtatcctggaaccacccccactgcccgtgcgactggctgtcgtgtctccccatcttcctgatgagcacgcgaacgcccagttgaggcgggagttgcttgctcacctcctcccgcgacaccaagtactgagatcagcggagagccggcaaggcctccacgagcacctgaggaggcaagatcaggacgataccctgtataccttttggtcaggcggcgagtacaggaagctgggcttgccccccttcgatctcgcacgaggcctgcacacctacgacccagctagcggccagctgcaacaaccggctgccctggcaccagcacccgcgcaggccacgcaagcgggtaggcagctgatagccctggtggtgttgcccgacgacctgacgcggtctgtccgggacaccctgtttcagcagctccagcagttgggccttaggtgtctgtttagtgtgagcaggaccctgctgcaccgaccacgcacagagtatatggcatgggtaaacatggccgtcaagttggctaggactgcaggggccgtgccttgggacctggcagacctgcccggtgtcaccgagcagacgtttttcgtaggcgttgatctggggcatgaccacacccaccaacagtccctcccggccttcaccctgcacgaccataggggacgccctcttcaaagctggacgcctccccgacgcaccaataatgagaggctgtcattggccgagcttaagaaggggttgcataggcttcttgcacgcaggagcgtggaccaagtgatcgtgcatcgagacggccgattccttgctggcgaggtggacgacttcactctggcgttgcatgatctcggcatcccgcagtttagcttgttggcaatcaaaaaaagcaaccacagcgtggcggtgcaagcagaggaaggatccgtgcttagcctggacgaacgacgatgccttcttgttactaatacccaagccgcgcttccgcggcccacggagttggaactggtccatagcgacaggcttagtttggcgaccctgaccgaacaagtattctggctgacccgcgtcttcatgaacaacgcgcagcatgcgggcagcgatccagccaccatcgaatgggccaacggcatagccaggactggacagcgagtgcccctggccgggtggcggctg

SEQ ID NO: 249 - DNA, 2190 bp, Artificial Sequence
  Description of Artificial Sequence: Synthetic polynucleotide
atgcccacccagttccaggaggtggaagtgatactcaaccgcttctttgtaaagaaactgtctcggcccgaccttacgttccatgagtaccaatgccagttcacccaggttccagagcaaggcagcgaacaaaaggccatcagcagcgtgtgctacaagctcggtgtgaccgccgtgaggctgggctcatgcatcatcaccagggagcccatagaccctgaaaggatgcgcaccaaagattggcagttgcagctgatcggatgccgagagctgagctgccaaaactaccgagagaggcaagctttggagactttcgagcgaaaaatcctggaggaaaagctcaaggaaacatttaagaagaccatcatcgagaaggactacgagttgggcctgatctggtggatatcaggcgaagagggactggaaaaaaccggtcacgggtgggaagtgcacaggggcaggcaaatagacctcaagatcgagacggacgaaaagttgtacctggagatcgacatacatcacaggttctacacccccttcaagctggagtggtggctgagcgaataccccaacatccaaatcaagtacgtgcgcaacacgtacaaggacaagaagaaatggatactggagaatttcgccgacaagagccccaacgagattcagatagaggcccttggcatcagccttgcggaataccaccggcaagaaggtgctacccagcaggaaatcgacgagagtagggttgtgatcgtcaaaaagatctctgactacaaggcgaaacccgtgtatcacctgtctcagaggctgtccccgatactgaccatggagacccttgcccagatcgccgagcagggtcgggaaaagaaggagatacagggcgtgttcgattacattaggaagaacatcggcacgaggctgcaggagagccagaagatcgcgcaggtcattttcaagaatgtttataaccttagcagccagcccgagatcatgaaggtgaacggttttgtaatgccacgcgcgaagttgttggcaaggaacaataaggaggtcaaccagaccgctaggatcaagagtttcggctgcgctaagatcggagaaacgaagttcggatgtctcaatctgttcgacaacaaaccggagtacccggaggaggtacacaagtgcttgctggcgattgcgcggagcagtggggtccagataaagatagatagctacttcacggggagcgactacccgaaagatgacttggcccagcaaaggttctggcaacagtgggcggcacaaggaataaagacggtgctggtcgtgatgccctggtcccctcacgaggagaagacaagactgcggatccaagctcttaaagccggcatcgcaactcaatttatgatccccacgccccaggataacccatacaaagcattgaacgttgctttgggtctgctctgcaaagccaaatggcaacccgtttacctgaagcccctggatgacccccaggccgcagacctgatcatcggcttcgacacttctaccaacaggcggctctactacggtacaagcgccttcgcgattctggcgaacggccagtcactgggctgggagttgcctgacatccagaggggcgagacatttagcggccaaagtatatggcaggtagtgagcaaacttgtgctgaaattccaagacaactacgacagctaccctaagaaaattctgcttatgagggatggactggttcaagacggcgagtttgaacagaccataagagagttgacccaccaagggatcgacgtggacatcctgagcgtgaggaagagcggtagtggcaggatgggaagagaactgacaagcggcaatactgccatcacctatgacgacgccgaagtgggaaccgtgatattctattctgccaccgactcattcatactgcagacaaccgaggtaattaagacaaaaacgggcccactcggttccgcgcgaccgctcagagtggttaggcactacgggaacaccccgcttgaactgctcgcgctgcaaacgtaccacctgacccaattgcatcccgccagcggctttcggagctgtaggctcccctgggttctgcacttggcagacaggagcagcaaggagttccaacggatcggtcaaatttcattgctccagaacgtggatagggagaagctgattgcagtg

SEQ ID NO: 250 - DNA, 3042 bp, Artificial Sequence
  Description of Artificial Sequence: Synthetic polynucleotide
atgctcacacaagaacaatttatacgcaactttagcgttatggccaatggtgaagtagacttctttcttggtgccggtgcatctattgcgagtggaatcccaactgggggtggcttgatttgggaatttaagaggacactgtactgtagcgagtgcggcatcagcgccgaaaagtacaaggacctgtcactcccaagcacgcgcaaaacgctccaggactacttcgacattaaagggtattgccccaaacaatatgcgcctgaggaatacagcttctatttcgagcaatgttacaccgatcccatggcccgaaagaggttcatcgagaatatggttagtgggagggagccaagtataggttacctttgtctcgcggaggccgttatgcaaggcaaagttaaaaacatttggactaccaacttcgatagccttctggagaatgccctccataggctttaccccatgaacaacgttttggtgtgctccgaggctaatagaggcagtgtgtgcctgctcaacccgacgtacccagtcataggcaagctccacggcgactatcgctatgattggctcaggaacaccgaggacgaattgcagcgactcgagaccagccttaaaggttacgcgtccagccaacttacagggaaacaactcgtcgttataggatatagcgggaacgatgagagcattatcagtttcctcaaggattgcatagataacccggcactgcttaccaagggtctgctgtgggctgtacgacgcggttcctgggtaaacccgagggttaatgagctgatagaacgggcgcacaaaattgggaaaccagccgacgtgatcgagatcgatggcttcgaccaattgatgttctcaatataccagatccagaactaccataatgagattatcgacggccaaggcaggctcctccaggtcggatctgacatccgcctcacggggaagcccgtggacagctttgtcaagctgaacgcttacaaggctgagtactgccccctttgtaacgtgttcgagacagacatcacatcctggaaggaacttcggaccataaccggcagcagtgacatcatcgccggtctgttctccaaacatatctattctctgtcttccgcagacaaattgaagaccgtgttcagcaagcactttctctctagcattaacaaggaggaggctcccgaacgggacattcgacggaacgagagtgtgtacattggattgatttaccagcttattaagcggaccctgctttcaaaagggatggtgtccttcgctaagaataaggtctataaccccgacagctgccgcagcgagcaaggctaccaagtttttgacgccctggagatcgcggtcagcttcgttgatggaaacctgtacctgaatcttatgcccacggtacatgtgagaggctcaaatggcgagagtctcgacaaagagtcctaccaaatacaagtcaaccatgtggtcagcacaatctacaataagcaatacaatgagaaactgcggttctgggagagcttgtgtctggacagtggtagaataatcttcgagaacgacggcttcagcatatcatttgtcgctcccgctgtctccctgggcggcaacaatcgaagagctaagtggctttccatgccgtcctgcaagtatgacgaaccactcatgtgcttctcagacactgacaaaagcaaacgagttattaaccaactgaagggactctgccagtacgggccaatcgactgctcttatatgcgggatagcaccacaaggcccagcgttaggctggccgttctgagcccgaaccaggacatggaccgaattcttgcacacctcaataaactcaacacccacgtccaaaacaggggcagcgataatttcctgccccactatgagggctttgagcaagtttacagaagggctctgagcgtccctacgaaggagcagagcaacatctgcatcggatacaacgtgaacgccatcctcaaaatgtctcctgcagagtttctggcttttatgaagcggggtatagagaaatactcccttcggtcaagcgatttcgatatactcgttatttacatcccagagtcattcgcgcatttccggacagcaaccgaaattagtagcgactacaatctgcacgatgcgctcaaactgtatgccacggataaggggattatccttcaactcatagaggagaaatctgtgaagtcatacgacccctgcaaagtaatgtggggcttgtccacctcactctacgcgaaggcgacaggggtactttggcatccagaggcaattagaaatgacacggcctacatagggataagctacgctttcagcgaagagaaaaggatttgtataggctgcagtcagctgttcgactcaaccgggacaggtattcggatggtccttagaaagataaacaatccgatatttctggggcgatccaacccctacatgagggaagacgacgctcgaattatgatgaccgagctcagggagcagtattaccacagcgcacctgtgaatactctcaagagggtcgtgatccataagaccacgcccttcatacgggatgagatagccggtataatgcaggcatttaacggcatcgaggtcgagctggttcagattcaagactattgctcttggagaggcatacgcttcggcggtgagcctgggaaaacggcgtttgggttcccggtgaagcgaggtatggccgtaaaactcgaccgagaaagcttcctgctctggacccacggctgcgtgattcacccggaactgtcaggcacgcataactatttcaaaggttcacgcggtatcccagcacccctcctggtccgcaggtttgcgggtaacgcaagtggcgacacattggcaaaagagattctgatgcttacgaagatgaactggaactccggtgacagtctgtacaaaacccttcccgtgaccctggattttgcgaaagttctcgcccgcatgtctaagcaagatgaggcgatctttgataaggcgtacgacttcaggtttttcatg

SEQ ID NO: 251 - DNA, 2361 bp, Artificial Sequence
  Description of Artificial Sequence: Synthetic polynucleotide
atgagggaaaccaacatctacgagctcagcggcctcgaaaccgtgagtaccagctacagacttttcgagttgcagggcgcgccagagttctctcctgagtattatgctggtgtgagccgcctcgtgaggacgcttagcaggagacaccaggcacccttcaccagtatccaacggggcgagaccatgttgctcgctgcacccgaggccctgagcggtgatctcgcagaacaccataatctggcacgctgggtggcgaccctgaagtcacttggagatagcatagagatagactgcagcgtgagcggagatgagctggaccccataaggctgcgattcctgaacttcatgatccaatctccattgttcaaccacggcgagctctggcagcccagggccggtgatgccttctactaccggaagcctgccgacacgttcgacggaatcgaactgtttgagggtattgccgtgagggccgtgccctacccaggaggcgggttcggcgttatgctcgacgcgaggactaagctgatctcacagcgggctgtgggcgcctacgcggacccgaatttcataaggaggctgaaaaacactagctgcctgtaccgaatgggagacatctggtacgagataaagatcagtggcgcgaatcagaccgtttctcaccccatcctgtttaaggacaaccagcccgtgtcactcaaagcctacctgcacgaacaagcacggcagccaatccccaagtctctgattgatcttaaaggtgacggcgtggtgttgacctatcgcggcagcgatagcgccgaggtcaaagcggcacccgcggaactttgtttccccatagtagacacccatagcaagaggggtgcccggcaccagagaaggagcatccaagccccacacatccgacgcagcaaggcttaccgattcaagcaaaggttcttgcgggacatcaaaataggaaatgccgtgttgagcgtggccgaccaacccgcagccctcaagaccaggcccatcgacttgcccgagctgcaattcggctccaataggattctgtacggcacggacaggggcggagaccgaatcgaccttcgccagtatgccaagaatcggcgaacgctgctggagcgcgcagacgtgggcttctttgagacttctcccctggagccccaatgtttggtacttcctaagagcgtgatgaacgcatggggcaacgagttcgttcgagacctgactgccgaagtgaagcgactccaccccaccggtaactacaagccaaccgtaatcgcgtttgatgatgtcagcgcaaccgtggacgccaggagccaagcagaagccatcttcaagctcgcggaagacggggatctccctccaggcgactgcgccattatgatacaccgaaccaaaggaaaggcaagagcgcaggaggagctgcccgcacttcttataaacaagctgagaaagagctacggagtgaatgccgccatattccacgcgactgtccccggcaacgcctaccgaagggaaagcgccagcgatggcgctcgctatgtgcgcaagcgggatgagaagggcaggtttagtggatacctgaccggagcggcgcttaacaagattcttctgcccaacgccaagtggcccttcgtgctcaaggacgagttggtggcagatatagtggtgggcatagatgtgaaacatcacaccgcagctctcgttttgatcgccgaaggcgggaggattatcaggcacactcttcgcctcagcaccaagaacgagaaactccctgctggtatcgtggaaacgaagctggtggaactgatttcaaatgaagcaccacacctgagcaggctcaccaaaacaatcgccatccatagggacggcaggatttggccctccgagcttaagggattgcgagcagcctgtaggaagcttgccgacgacggccacatcgatcctgcgttcgatctgaacgtcttcgaggtgagcaaaagtgcccctgctaggcttaggctgtttagcgtcgaccgcagtgctggcagaaagccgaggattgaaaacccggaactgggggactggatgatgctgacagaaaccgacggctacgtttgcacgaccggtgctccgctgttgagaggtggtgcggctagacccctgcatgtaaagcaggtcgcaggtgatatgagcttgcaggacgccctttccgacgtgttccgactgagctgtctgacctggactaggcccgagtcatgtagcaggttgcctatcagtttgaagctctgcgatatgctgctgatggacgagggaactgcccacgacgaggacgaaatccttcatgctaacgacgacaccccagccgttagcgcc

SEQ ID NO: 252 - DNA, 2301 bp, Artificial Sequence
  Description of Artificial Sequence: Synthetic polynucleotide
atggcgtttaggcccggtgaacgagtcagaccgcagctcgcgctgaatgcgatcagggtccttacaccccctggcaccatccccgccagtgtagtccaattcgacagagcgctgctgcacgcatatcttgacagacccgagaacgacgtattcgctacccgacacggggagactgatatggcggtcgtacccctgaccagcggtgcgaacctgccaacggacagaatggggcttccagctgcagagcacctcaggctggtatctgcgctgacaagagaagctgtgtttcgcctcctcgcggccagcccggaagcggatctgctgatccggcgacgcccaccgaccgtcgcggggaagagagaaaacgtacttgcagaggacattgggctcccggactggttgaagaaaagacttgtgctggagttcgacacgcgcatattgcaaccaccgagaggggacgcctacgtggtgctgacgtgtagtaaaaggctgcgcacgacaatagacgcgagttgtcgcacccttctggaactcggtgtaccactgacgggtgccgcagtcagctcctggagggaagatcctgaccccaaggtgagccggcgattggcctacgctgggcgcgttgtagaagtagggcaggacacgctcactctggacgaccacggagctggtccgagtgttgtctccagcgaagacgtgttcctcgagccgactcgagcaaacttcaacaaggtggtggaagtgataacccagggtaactccgaacgagccttcaaggccgtacaaaaagcagaagccgaatggcacggcgggaggcggacaatcgaaatagtgcatggtgtcctcaaccaactcggcaaccggtcaatggttcttgccgatggcgtgcctctgcggctcgggggcttgatagaccaagcggtcgatagcgacgcattccccccagccgaggcggtgtggcgccctaagctctcattcgaccccgtgcacagccccgagacatcaaattcctggaaacagcagtcactggacaggacgggccctttcgataggcaaacctttgaaacaaagagaccgcgaatcgcggttgtccatcaggccggaagaagggaggaagtggctgcggcgatgcgcgatttcctccacggaaggcctgacatcgccagcgatacgggcctggttccccacggttcaggactcctcggacgctttaggctccacgaacccgaagtgagatactttgaggccgcaggcagggggggacccgcttatgccgacgcagcacggagtgcgctcagggacgcggcgtcaagggacgaaccatgggacctcgcaatggtgcaggtagagcgggcgtggcaagatcgcccacatgccgatagcccgtactggatgagcaaggcaacgtttctcaagagggatgtgccggtgcaagcccttagcacagaaatgttgggtcttgatgcatttgggtacgcgaacgcacttgcgaacatgtcacttgcaacgtatgcgaaactgggcggtgccccgtggcttttgtttgccaggtcaccaaccgaccatgaactggtggtcgggctcggaagccacactgtaaaagagggccgaaggggtgcgggtgagaggtttgtcggtatcgcgaccgtattcagcagccagggccattatttcttggatgccaggacagccgcggtcccgtttgaagcctatcctgctgccttgagcgacagcatcgttgacgcgatcaaaaggattggacgagaggaagcctggcgaccaggcgaggccgtcaggttggtctttcacgccttcacccagttgagccgagaaaccgttcaggcagtggagagagcagtagcaggcatcggggccaccaacgtaagcttcgcgtttctgcacgttgtcgaagatcacccgtttaccatgtttgaccgagcgtggccagacggaaaggcgacattcgcccctgaaagaggtcaggcgcttcgactctccgagcgcgaatggttgttgacacttaccggcaggcgcgaagttaagagcgccagtcacgggctgcctgggccggttctgttgcgacttcatgacagcagcacctatagagacatgcccgtgctcgtccgacaagcatccgacttcgccttccactcttggcgcagttttggacccagcggactccccatcccgttggtttacgcggacgaaattgcaaaacagctcagcggcttggaaagaacccccggatgggacacggatgcggctgagggtggccgggttatgagaaagccttggtttctg

SEQ ID NO: 253 - DNA, 3128 bp, Artificial Sequence
  Description of Artificial Sequence: Synthetic polynucleotide
ggtgtcgtgaggatccatgcctaagaagaaaagaaaggtggaggatccaaagaaaaaacgcaaggtgggtagcggcagcatgccatcagccgagaggtgcatctgggagtggaagagggaaatcttcatcactaaaaaccccttgctcagggaaaccgtcggcgagctgtccctccagggcacgaaggaccgaatccaaaaatggctcgatcaacgcggcgaataccccgcactgaactccccagaggaatactcattttatgccgaggagtgctacatcaccgaacaagacaggcggagcttttttcagcagtacgtagaggtcgccaagccgcacataggttatagattgttgcccctgctggcacagaccaagatcataaaaactgtatggacgactaactttgacgggcttgtcgccagggcctgtcattccaacgacgtggtgtgcatcgaagtcggtctcgacaatacccaacgcattacgcgccagcattctgagggggagctgcgggttgtaagtctccacggcgactaccgatacgatgagcttaagaatacagatgagcagctcaggtaccaggaggaggcgcttaaaaacaatatagagcacgagctgcaggactacgacctggtagtgatcggttactccggcagggaccggagcctcatgaacgtactcgaaaacatattcagcaaggccgtgaagagcaggttgttttggtgtggctacggcgaaacgataagccagcccgttatggagttgttggagctggcccgcaagaataatcgagacgcattctatgtcagcaccgaaggcttcgacgacaccgttgaaagaatcagtaggaagctgcttgacggcaacatgctgtccaaagccttggctgagatacaggagaccacttgcatcaccaaccaatctgccaaattcaccgcacctgaaaacgacatcagcagccttattaagtcaaacgcataccccctcctgaagctcccgtctcagttccttaaagtgaccctcaaatacccggaggggtcctttagttacattgattggcttaactccaaggttgacttcaaggaggttgtgttgtctaagatagacaaggagatcatcgcgttcgcggatgttgataagctgaggaagtatctgggcgagttctacctgtctacgcccacggtggtgaactttagcaaaacggacgtgcttaacgatactcgcattcagagtctggtgaggcgcggacttatacagtccatcgtaaaaaacctgaacctgtccagcgaccagaacaagcgaatatggaatccagacgtgagctccatcgaattctacaacggcaagaagtacaaaatcatcgacgcgctcatcctcaatcttagttttatcaaagatgacatctacctcacgttcaaacccgatctgctggtccttaacctcgacgagagcctgccagacaacgatatagttaagactatcaagaacaaaaagttcggctaccagcacaacaaagagtacagtcagatcctggagaagtgggccaaccttataacgaagaaggatttggtcgtgagtggcgggagcgtgttcttccttgggaagaaaccgctgtatgccggacttgtgtcttacgccgcgaggaaactcccaacagattataacaagcacgccacccagaaaggactgatcattcaagacgcgaaactgattttttgcagcaattccatctccaatgagatttctcacatcaaccccctgaaggggctcgtggaaaatcgcccgtgggactacaaaaacaccagctctgggctgtgccccgagatctgcattaacgtgatctcaaccaggcaggacgcgggtgtggtgagcaaccttctccgaggtattcacgagaagtccttcccggaaaaatccgagcaagattacttgcaccccttccatgggttcacaaacgctttcggggtgcccatcacgatccctaagatcggtgagaatacgtggcgctttgtggacgaagcactgagtgcacagaaggccatcgataacgcgaagaacctcgcgaaccgcatttgctatgaacttgacagcctgaagaagcttgaactgcggacgggcaccgtcgtgatcatatacatccccaagagatgggaagcattgacatccatcaagtctgagcatgagtacttcgacctgcatgattacatcaaggcctatgctgcgcaacagggcattagtacgcaattcgtgcgcgagaaaacggttaattcaagccaaagctgccgggtaaaatggtggctcagcctggcgttctacgtgaaggctatgcgcactccgtggcggttggagagtattgataaccaaacggctttcgtggggatagggtacagcatcaatcgcaatatgcatcccgagaattccaagcggataattcttggatgctcccacatatactccgcccgaggcgaaggcatgcagtttcaacttgggcgaattgaaaatcccattatccaccatcacaatccctacatgagcgaggaggacgctagacgcaccggcgagaagatacgacaaatgttttttgatgccaagatgcaactgccacgcagggtcgtcatccacaagaggaccgctttcactgaagaggaacagcgggggttcatacaaggattggaaggcgttgaggacatcgagctgatcgaaattaacttcgaggactccctccgctatttgtctagtaagtttgtaaacagcaagctggaaatcgacgggttccccatcgctcgggggaccgtaatcgtgcaaagcagcaacaccgcgctcctgtgggtgcatggtgcaacccctagcgcgcaaaatccaacgtttaagtatttccaaggcaaacgacggatccccgtgccccttgtcataaagcgctacgtggggcagagcgacattagccagttggcgaacgaaatattgggcctcagcaaaatgaactggaacacctttgactattactccaggcttcctgtaacccttgagagcgccaatgatattgcccggatcggcgtgtatttcaacaatttctcccccatgagctacgactatcggctcctcatatagtaactcgaggttaacttgt

SEQ ID NO: 254 - DNA, 3224 bp, Artificial Sequence
  Description of Artificial Sequence: Synthetic polynucleotide
ggtgtcgtgaggatccatgcctaaaaaaaaaaggaaagtcgaagatccgaaaaagaaacgcaaagtagggagtggtagcatgatcaaacacctcaagttcgacgagttccttcgcagcgtgtcaattagtaaggataacacgtactccatgcttatcggtgccgggtgctcaatcactagtgatatccaatctgcctatgactgcatatgggaatggaagaaaataatttacaagtccaataacttgaatactcaggactggatagagaattacaaatcccccaaaacacaagacgtgatacaaaaatggcttgacaaccagggaaacaaccctgagaaagataatatcgaagagtactcattctacgcaaagaaatgctttccgatagatgaaaatagacgccagtacttccaaaaaatctgcgctaataagaagcccagcgtcggatatcgagccattcctctcctggtgaagcaaggcatgctcgactcaatttggacaaccaattttgatgatcttgttaatgtggcgtgtataggtggtggcgttcaggggattgacatatcccttcagacggtaaaccgcataaatcaacgcaatcaaagcaaaaatgaactgcctattataaagctccacggggatttcaagtatggcgaccttaagaacacgagtgaggaacttcagaatcaagacgaaacgcttagatcaaaacttttggactacttgagcgataagaatctcatagtcattggctatagtggtcgggacaactcactcatggagagcttgaaagagacttattcaaaacctggtgcgggaatattgttttggtgtgggtatgggaacagtccatcaaaccaagtgaaggaactccttaaatttatcaaggataaggggcgcagcgcattctatgtttccactgagggattcgataacaccatgctgaacctgaccaagcatgttattgaggacgatgataacctcaaagaggaattcagagaactcaagaagagtatcattaataaaaatacaacgaccccgtttacgttgaacccggaacgaatcaataaggtactgaaaagtaacctctttcctattacattccccaaagagatcttcgtattcaatgcgaccttcgataagaaaccttgggagcttgttaaggaaaaaactctgagtgactatgaaatttcagcgattccatttgaaaaagacatatgggcatttgggactgctaataacgtctacgaaaagtttgcagatatcattaagggcgagatccaacggaagcccctgaccgatatccggctttataatcacaacataaagttcctgctcctgtcaagcctctgcaagctgttctcaaaaacctacaatctgaaaacggactttcggtctaagatttgggatgagagctcatacaaaacggttcacaaccaaaaggtctataacgctataaagatcgatctcgtcaaaatacaagaacagtcatatttgtcactcaatccagactttcaattggcagatgataacgttcccaatgatatcaaccagcaggttggactggaattttttcataagatctataacgacaaatttaacgactatataaacatctggagaaagaagatcctcgaaactacgtcatacgaattgccactgaactccggcaccgggttcgtatttaaaatctctaagaatccaattttcacaaatatagatgaccttaattccaactatacgaacgagcacaatatacccataaacatgattaaacttaagggggttcaattcaaagagacgaacctcctctttagttcacaaaatggagataaagtggttaaggagacccacccaatgagaggcctcgtcaatcatagcccgttcgataagggattgagtagtcttaaaaacactacgatcaacctggggatcgtatgcccccaacaggatagcgaaaatttttatacttttttgaataaacaaaaccaagagattaagaacgttaatattaaggatcaatatgtaatcgattacaaaggatttcacaacacatacggtttgagtctgaacatacctactacgagcagtcctaattgggaaatgactaacgagcctgtctcaagggactcaaagaaaataattcatgaaatcaagaataatatttgcgacaagataaataagctttgtagtataggcggacagaagacaatagtaatatttatccctaaacgctgggacaacttcgtacactataatgatgccgtggaaagctttgatcttcacgattatatcaaagcgttctgtaccgaaaaaaaggttacgtctcagttgatacgggaaaagacgatactcgataataacctcgagtgccagatcaactggtggttgtcactcagttattttgtaaagtccttccgaacaccgtgggtaatcgacaacaccgacaataaaacagcttttgcgggcattggttattcagtagagtccaaaaaagaggataaggggcacattatacttggctgttcccatatttacagtagtaacggggagggtctcaagtataagctttccaaggttaatgataaaatagaatggatcaagaaaaagccgcatctgtcctacgacgatgcttacgaatttggtaaaaatgtgatcaacctgttttacgaaagcatgaatgaggtgccaaaacgagtggtaattcacaaacgcaccttttacactgaagatgagaagcaaggcatacttgactctttgcacgataacaagaaaatagaaaacatagacttgatagaaataaatttcgaagacaacataaggtacgtctcctctaagatatataatcgggaggcaaaaatcgacggttactcagtatcacgcggtacctgtatccttcttaacgaaaaagaggcacttttgtacgcccatggcgtaatcccgagcgtgaagaatccgagttataatttttatccgggaggaaggtacataccgaagccattgaggataataaagcattatggagttggttccctggaacaaatagcaaatgaaatactgggtctcactaagatgaactggaactctctgaacatgtatagccaaatgcctgccacgatcgactcaagtaataagatagccaaaatagggaaactcatagagaatagggataaagtagagtacgattatcggtattttatctagtaactcgaggttaacttgt

SEQ ID NO: 255 - DNA, 2483 bp, Artificial Sequence
  Description of Artificial Sequence: Synthetic polynucleotide
ggtgtcgtgaggatccatgcctaagaagaagaggaaagtggaggatcccaaaaagaaacgaaaggtcggcagcggttctatgagcgagctggagaccaacatcttcccaatcaccaacttgcatgagcttgaaagcaggttcaggttgtatagggtgaggggcctgagcatcaaccaagaggagtacgaccccaacacccagacattggtgaggaagctgagctacagcatgaggtctcccgtagctgtgatacttaggaacagcgacccgttcctggctcttccaatcgacgcacccgagcccatctctccgtacccgctcgtgagagccactgctgtgttcgagaagacggacgaggtatttactctcgattacgaaagcccaactcccgagacagatgcgctgcgaataaggttcctgcaatttatcatccaaggcgcgctgtttaggaatcccagcctgtggcagccctcagctggcacccccttcttcgagaggagccccgtgttggagaaggccggcatttgcgcgtaccgaggcttctcagtgcgagtcgtgcccatagaaggtggtaaactgggaatctgtgtggacgttaagcacaggtacgtcagcaaaaaccccatcgaagcaaacatcaagcgcgaggaattcaggaaatacaagaacggcaggtgcatataccactacggccacaactggtacgagatcaagttgcaagaccacactgggctgtccgtgtcagagcagatgatcagcaacgggacggccaaacccataagcttgtatcagttcattatgaataacgcgcccaagcccctgcccagggaggtcatagacatgcctcccgactcacccgcagtcaaatacatgaccagcagggatgaggtgcgctacgtgccctccatcctttgttatccggtctttgacacctctgaccccagggtgaagccgacgcataggggcacaatcctcctccctaacgtgaggcgacagtatatccacaatttcgtgaactcacacctgaccgatgtgcgatccaaagacatggcaatccgaatcagcagcaagccagttatcgcccctaccaagattttcctgccgcctgacctggcattcggcaacaacaccgtgttcagcgtaagaggcacacccgggaccacgtatgttagcctggagcagctgggccagacgcggataagcgccctcttcaatcagaaaataggcccttatgacagcaggccgctggataggcagtacatgattctgccgaaaagcgtgtgggactcccacgggccagtatttctgaatgactttaagaaaatcatgaacgagctgtacctgcacgaactgccctacaatcccatcgtcgtgacctacaacgacttgagcgccaagacctacgcgcttcagggaagggctattctggacgccgtggacagcgaactgagagagccgggatacggcgtggttatgatacacgagacggtggaccgccggaatagacagcacgaccagcttgccgcgatggtgatgagggagctgcggaacaggaggctgtatgtgagcgtgatccataccacggtgacgaaggactgttaccaattgccccagaacgcccccattggcaaggcctactgcccggtagcaggcaagcagggcaaactcaatggctacttgaggaacgtggccattaccaaggtgcttctgaccaacgagaggtggcccttcgttatatctaccccgctgcatgcggactttaccgttgccttcgacgtgcagcttaacaccgcttgcttcacattcatcggcaagagcggctccgacatccggaccgttttgaagaccagtaaccaaaaggagaggttgagcaaggcacaagtaaggcagacgctcctggaagtgctccgccaggaggttggcttcggtcgacggaccatgcagaccatagtggttcagagggatggcaaattgtttgccagtgagatcgcgggagcaaaagacgctatagagatagtgaagaaagaaggcatcttgcccagcgatgtgtcactgaatttcatcgaaatccccaagagcagcgtcgccccatttaggctgttcgatagcagccccaggccagggcagcctgaaatggcgaacaacccaagaatcggctcctacttcatcgcgacgaattacgacggttacatttgcaccaccggcaaggagttttaccatcccggtacggcaaatcctctccacgtgaagtacatcgagggaaatatgccatttgagaagatcctggaggacgtgtacgccttgacttgcttggcgttgaccaggcccgaagactgcacaagggaacccttcaccatgaaactggccgatatccgactgagggaacatgccggaggctacgacgaagatgcattggcgtatgatgatgaaaatgagaacgacgaggataacgagaatgaatagtaactcgaggttaacttgt

SEQ ID NO: 256 - DNA, 2306 bp, Artificial Sequence
  Description of Artificial Sequence: Synthetic polynucleotide
ggtgtcgtgaggatccatgcccaaaaagaagaggaaagtggaggatccaaagaaaaagagaaaggtgggtagcggaagcatgaccgaggccttcctcacaaccaggaggggcttcgtgcaaaagctgacgctgaccaggtacgattacctgaactggatcatcgagtccgaggcgcagaaagccaagctgaagaactggcttaagaacaagagcgggtttctgacccacgagatcgaggatacctgtttcttcaccttcgagaggcttctggaggagagtactaagcagtatagagcctccggcgagaaaactctgtctgccccgttcaagaacacgcaactgatctcaaatctgatcggtaccatattgaaaaaggagttgagcaagaaatacaagcaattctttagtcaaaacatcttcatcgtgagcaccatcgatctgtatccattcaatctcttgaaggcgttcgagttcaacatcgaagtgtttgacagcggccacttccttatccacgtcaacccagtgtctaaaattgtaagcagcaaggttgtggacaaggagtatctggactacctcaagaaaagcaacctcaacaacagcaaaaccaccgagatggagttcgcggtgatcaaccatgaaaggaatttcagacttaaattcgacctgcttgacgaatgcatctttgagaagatagagaagctgcacagcgagaagaatatgtttacagccacttttgattaccatttcctggccaacttcagccccgagatcttcggcaaaatcgtggaacatactagcaaggatctgaagcaggccatcatgttcctgaatgacatactgagcaatatcaagctgccgagctttctcaacctgcacgaggaacgatactttaaggtcaatatctccgaattggaccgaaagaataatcttctgattggaagcagtttcgaggtaataaccatatactcaaaaagccagacccagtatggactgaggattgagttcactcgcgacagcataagccgggacgagcttataacaatctttctgaaaaacgaagagctgatcgagaaactcaacgacattaaagtggtccccgccaccatcaacgcaaaaatcgaacagaagaccggctggaaaaacccctacatcaccaatgttttcatcgataacgtgggtgccttcagcaccagcagcctgcaaagcgcctcatacttccacggcatctacaaggccgttaacaactggaatatcctgcccatcgtgtacgaggacctcgacatcaaagtattcgagaacctgatgctgcacgcctttaacaagaacgccaccgaattcaagatcctggaacccatcataatcaagtccacgaacgaaatcgacaaacaggaggtgcagaggagcatcaaaaaccaggccggcaagaccatgatcgcagtgttctgcaagtacaagataccccatgacagcttcgcccccctcaagggcttcaagtatcagatctatcaaggcgacaccacggacaataagcagaatagggccaaactgagtaacttcacgtgcaagtgcctggagaaaatgggaggggtgattgcggcaatcgcggacacaagcatagccgaggatggatatttcattggcatcgaccttggccacaccacaaatggcaaggaaaagttctccaacctcggagtgagcttgtttgatagcctgggcatcctgttgggcgattacgtggagaaggagattccaagaagggaaaacctcatcgacacgaactgcctcaatgcttttaagaaacttgacaaaatgctggaagctaaaaaactgaacaagcccaaacacctgatcatccatcgggacggcaaactgcacttcaaggatatcaacattctcgtaagctgcgtggaaaccgtgtggggtaagataaacgtcgatatagtcgagatcattaagagtggcttccccgtgatggctataaaggacgagaccaacaaaccaatcaatcccataagcgggaccagctaccaggacgacatccataagtacgccatactcgccacaaacgtacaagccgacgaacagtcagccgtaataaacccgataatcataaaacacaaatacggagagctggagtttagcaaaatagttgaacaggtgtactggttcacgaaagtgtataccaataacctgtacaatagtaccaggctcccagcgactacactcaaggccaacaacgtggttggcacgtctaagaagctccacagaagtacatacttgggctagtaactcgaggttaacttgt

SEQ ID NO: 257 - DNA, 2285 bp, Artificial Sequence
  Description of Artificial Sequence: Synthetic polynucleotide
ggtgtcgtgaggatccatgccgaagaagaaacgaaaggtggaggacccaaaaaagaagcggaaagtggggagtggcagcatgttcgtggaactgaacgccttccccatcgacatccgcaatatcggtatcgtggaggcctgcgaggtgccgtacgacaaggaggtgctttatagcctgcatgataacccacaaaaagattaccatgctatcagaaacggcaaccagatattgatattttctaatagcaaaaactaccccatccagggtacaatcaaggagataaatcttgcacaggactaccgcatcctgtttttccttattaaggagtccattatcaagatcctgacgcagatcaaacgggagcctttcaagttcaacccgattgagttcatctcaccaaaggagaacatcaccgagaatatcctgggaatcaattacccatttcaaataaacgccaaatattcaatcgataccagaatcattcagggggtgccctgcctcaccattgattgcagcacgaagaaatacaacaaggaatccctgatctacttcattaacgacggcttcaacctgattaacaggtacgtgatctcaaagcaaaacgagaagtataagcgcgtaggtaagatactgagcattgacaacaacatcgtgactgttcagagctgcgacaagataaagaagtactccgccgaggaaatcaccttggaggcgaactctaagaacaccaaggactatctggcatacaagttcccctataagttcgagcagatccaagaaagcattaagaaggcgatcagtaccttcacccaggggacctctaagcagataaacattggcaagatctgggactttttcagccagaaaggcatcttcctgttcaacggccaccgaattaacatagggctgcctcccgacatctcccagcaatgcaagaaccttgtgtacccgcgctttttctttagcaactcccgagaaaacaattccaaagagaacggcctgaaggattatggcccttacaccaggaattactttgacaggaataaccccagcatttgcgtgatttgcaacgctaaggaacaaggcaaagtggaacagttcctgcacaaatttctgaagggcatacccaatagccataactttaagacgggcttcgagggcaagtttcatattggcctctctcagatagaatttttcacgaccagcgacgacagcctgggcagctaccagttggctatccagaaggcaatccaaacgaggactaaccaaaactctagccagtgggacctggccctggtgcaaaccaggcagtccttcaagaaattgttggtggagcagaatccgtactttattagcaagaaaatgttctttcagcatcagatccccgttcaagacttcaccatcgagctgaccaatcagaacgacaaaaacctggagtattctctgaataacatggctctggcgtgctatgcgaagatgaatggaaagccctggctgcttaaatcaagccctactatcagtcatgagctggttattggcatcgggagcagcaacatcatcatcgaggaggacagtctgaaccagaggatcatgggcatcaccaccgtgttcagcggcgacgggtcttacatggtctcaaacactagcaaggcggtggcgcccaatgagtactgttgcgccctcatagacacacttgagcaaacgatcaagaagctggagaaacttatgaactggcagagcaatgacaccattaggctcatctttcatgccgccgtgaagaccttcaacaaaaatgaaatcctcgccgtaaaggaagtgatcaaaaagtatagtgagtacaagatcgagtacgcttttctcaaaatcagcagcgaccacggtctgcacctgttcgaccactcaactaagaatgagaataagggtaaattggctcccaagaggggtaagtattttgaactgagtagccatgaaattttgctgtacctcgtggggcagaaagagctgaagcaggtgagcgatggccacccccagggcgtgatcgtgtccctgcataaggacagcagctttcaggaccttaagtacctctctaatcagattttcagttttagctcccacagttggaggagctactttccctctcccctgcccgtgacaattcattatagcgatctcatcgcggagaacctgggctggcttaacaagctgagcggctgggacgatacaatcctgctgggcaaacttggacagacccagtggtttctgtagtaactcgaggttaacttgt

SEQ ID NO: 258 - DNA, 2123 bp, Artificial Sequence
  Description of Artificial Sequence: Synthetic polynucleotide
ggtgtcgtgaggatccatgcctaagaaaaagaggaaagttgaggatccaaaaaagaaacgaaaggtaggcagcggcagcgtaaagcttaatcacttccccctgaatcccgctcttgcagtgttcaagactacctacaggcacagaaaccccaggggcttcctgggattcgttaggtcacaagggttgaccgcggagagagttggcgaggaagtgtgtgtctatcacggtcttccccacccggcttttagaggagccaccgcccaaggacacaccagactggcgcctggtgacaccgattacgacaggggcgtacttagtctgatcggagccgccctgctgaaagcgggttacgtgcttactgagcgcgaaagggccgcagtgcaccccacgcagcagagagtgcccctgcacacccctaggaaactccctgccgaaattgcggtgaatgcccatcttcgatgggaatgggaactggaacggcacagcgggaagtcttggcttgtgcttaggcccggacgcatgtttttgagtgcgctgagctggcacgatttggacctgagggcatgggcacaggagttgccccagagcgtacagcaactgcacgcgctgtgtcttcgctccggacgacgagaacgactgaggcgcatgggtaacacgtgggcgttccaacgagaggatagggagcaagagggcaggtggcacctgagctttagcactaaggcgctttccgacctgaacctgtccggcgatgctcaccatgctgctagcctgagcatgcccgatgtgcagaggctcgtaaatctgccgggtctgtggcagccctttgtgacaagccttgaagtccttgaggtgcctggtaaggtgatcgagggcaaaaggctgaggttcggacgaggaacagggcgcgacgtcacggatgtacacaaaaggggcatccttcaccctccgccgcagccagtgcgccttgcggtcgtgccccccattcaggcggacgaagaggcggatgagcagttgagacgcgagctccttgcccacctcctgccacgggaaaaggtgttggcccaccccgaggcttcccagggcctcaagaagcacttgaatcgaagggaaaccgacgacaccttctacaccctgtggagcgctggagactactgcaaactggggctggaaccctttgatctggtgcgcgacctccataggtacgaccccggcacgggtcgcctgctggctccagagaagttgcatggagcagcagccgccgcgagagaggctggcaggcaattgattggcctcgtgatcctgcccgacaccatagggcgagatgagagggacgcactgtccgacgaactggccaagctgggtgtgaagaaacttcagcacatccgcagggacatgctgaaccggcccaggacgcagtatatggcctgggtgaacgtggccgtgaagctcgcccagagggccggagcagtcagctgggacctggaaaagttgcctggagtgtgcgaacagaccttcttcgttggcgtggatctgggccatgaccatcgggagaagcaaagcgtcccggccttcagcctgcacgagttccgaggcaggccggtcgactgcctcacccttccaaggcgagccggaaatgaaaggttgagcctggcggagctgaatcaaggcctgaggaagctgcttaagggtaagaggccagcccaagtgatagtgcatagggacggcaagtacctggagggggaggttgatgacttcataatcgctttgaacgacctcggcgtgccgcgcgtcagtcttctcgccgtcaaaaagtccaacctctccatggttgccggcgctaaggagggagcgtttttgccactggacgagcggcggtgtctgctggttaccaatacccaagccgcggtagctaggccgacagagctggaggtgatgcactcagatcatctgactttcgccgagctgaccgagcaagtgttctggctgacccgagtattcatgaacaacgcacagcatgcgggtagcgaccctgctaccgtagagtgggcgaacgggatcgctaggaccggaaagagaattgccctgtctgggtggtccgcctagtaactcgaggttaacttgt

SEQ ID NO: 259 - DNA, 2330 bp, Artificial Sequence
  Description of Artificial Sequence: Synthetic polynucleotide
ggtgtcgtgaggatccatgccgaagaaaaaacggaaggtggaggaccccaaaaagaaacgcaaagtgggtagcggctcaatgctcgactttagccttacccagaaaggttgggtgctgcccatcgtactgaacgcctttccgctcaaggtaccggacatggagctcaaattcgtgcagatcccctacgacaagacgaccctggactcactgaggtcaagccacaagatgacccacgtcttcaggaggcaaggcgacagtatccagatcttttctagcgacggcacctttccaaagagcggcaccccccagaccctccaactgaaggataatctgggaatctttttctctcttgtaaaggacggcctcctcaagcacttcgccggtttgggccgaaccccgtgcggattcaaccccattgaggtcgtgtcagctcaggccaaagacaatcttctggctagcatcctcggagaagcctacccgctgaaaatttgcgccaagtactccatcgacaccaggacagtgcaaggtcaaccgtgtctcatcatcgactgcagcactaggagagtggttaaagagaactgcctcttcttccttaagaccggctttaacgtgattggccgctatgtagtgaccgagcaggacgacgggtttcggaagctgctgggttttgtggaaaactgccacgaaggcaggacactgagcgttataaggccagatggccaagccgtgcatgccgaggccaaggacgtgtatctcgaggcatctagggccaacttcgacgactacatcctttatacgcacggaactaaaaaggatagcatcgtggagcgaatcagacaaagcgtgagtatcttcaacggcggtaagaacaagaaagatagaatcgacgcgctcaaaaagtacatccaggccaccaatataagccttttggatgggaccaggatcgaaatcgaggagcccagcgacattcagaaggactgcgcccagatgcagaagcccgtgtttgtgttcaatgacaatggcgaggccgactggaccgagaaggggctgactcagaacggcccctacaccaagcgcaccttcgaccgaaacgaccccagcatctgcgtgatctgcgcacaacacgacagggggcgagtggagcagttcgttaggaaactgctgaaaggcatggctaacagcaaatacttcagaaacggccttgagggcaagttcgcgctgggaacgtcccgggtagaggtgtttgagaccagcacaaatagcgtggacgcctataagagcgcgatcgaagccgccatccgcaagaaggccgatgacggcggcaggtgggacctggcattggttcaagttaggcagagcttcaagcagctgaaggtgactgacaacccctactacttgggaaaaagcctgttctacatgcaccaggtgccagtgcaggatttcactatcgagctcctgagccagtccgactattcactgggctacagccttaacaacatgagcctcgcttgctacgccaaaatgggaggagtgccctggctgctcaagtcctctcccacccttagccacgagctggtgatcggcatcggcagcgccaacattgtccaggagaggggggcacacaaccagaggatcatggggataaccaccgtatttagtggcgatggcagctacatcgtcagcagcacgtccaaagctgtggttcccgaagcatactgcgaggcgctgactagcgtgctgggcgagaatatcgaaaaaatccaaaggagaatgaattggcaaaagggtgactcaatccgactgatcttccacgcccaagtgaagaagttcaacaaggaggagattcaggcagtgcgagccgtgatagacaagtatagggactaccagatcgagtacgcttttgtgaaaatcagcgagaaccacggcctgcacatgtttgacagctcaaccgccaccatgcccaagggcaggttggccacacacaggggtaagacctttaagctgtccaaaaacgagatgttggtctacctgatcggacagagggagctgagacaggaaaccgacggccaccccaggggtgtcatcgtgaacgtacacaaggacagcactttcaaagatatcaagtacctgagcgcccaactgtactcttttgcgagtcattcttggaggtcatacttccccaaccctatgcccgtgaccatcacctacagcgaccttatcgcccacaacctcggctggctgaaccagctgcccgggtggtctgacagcgtaatgataggtaaaatcggtcatagccagtggtttctgtagtaactcgaggttaacttgt

SEQ ID NO: 260 - DNA, 2906 bp, Artificial Sequence
  Description of Artificial Sequence: Synthetic polynucleotide
ggtgtcgtgaggatccatgccgaaaaagaaaaggaaggttgaggatcctaaaaaaaaaagaaaggtcggcagcgggtctatgttcgacattggatcaatggtgagagttaggggtcgagactgggtcgtgttgcctggcagttccgcagactttctcctgcttaagccactcggcggatcagatgcagaaacgacaggggtttatgccggtcccggcggcgaagttgtgagatcagcgacttttgcgccacccgatccgcaagcgtttggaacagcctctggcgctcggcttctcctgaatgcagctagattggccgttaggtccggcgctggaccgttccgctcccttggcaggctgggggtagaaccacgcccatatcaacttgtccccctccttatggccctgagacaaagtaccgcccggctccttattgccgacgatgtaggtataggaaagacagttgaagcggcactcatcgccagggagctgcttgaccgcggagagatagagcgattcgctgtgctttgtccgccccatctggctggtcagtgggtaggtgagctgaggagcaagtttgggatagatgccgtcgcggtcctccccggaaccgcgcgaagactggagcgcggctgtaacccaggccaatctgtgttcgccagataccctttcgcagttgtctctctcgacttggtcaaatcagaccgatggcgccaggattttttgcagaacgcccccgagtttgttatcgtcgacgaagcgcacgccagtgctgagggcgaggggttgggcgcgcgaagacatcagagatatcgccttttggaggaccttgcgcgagacccagagcgacacttgatactcgtgacagctacgccacacagcggaaaggaggacgcattcagatcccttttgagattgctcaaccctgaattcgccgctctgccactggatctctccggcgctcaaaacgaaagagctcgggcagctatcgctcgacacttggtgcagcggaggaggggtgacatcactgcataccttcacgaggacaccccatttccagtccgaagggacgccgaggttaagtatactctgcaccccgattatgcggcattgttcgaggacgttctggcctatgcaagggagtccgtgcacgttccaggcgaggcgcatagtcggacgcggatacgctggtgggccgccctgggactgcttcgggctttggcttcttcaccccaagcagccgcagccactctccgggaaagagcaagcaccgaaggcgagactgatgaagcagttattgaaagacttggcagggaactggtgcttgaccccgaagacggtgaacatgggctgctggacgtcacccctggagcgcaggtcgacggtgaagaaagcgggaccacgcgacgccttctcgcactcgcagagagggccgacgctctggctggggccaaagaccggaagctcgcactcctgaccgcacaggtcagggatcttctgcaggaaggtttcgcgccgatagttttttgtaggttcattgcgaccgcggaggcagtagcggagcacttgaggggagttctgaaaggagctgaagtcgtggctgtcacaggaaggctgacgccagatgagcgcgtcgcccgcatcgaagagcttgcaccccacgagcgacgggttcttgtggcaacggactgccttagtgagggcattaatctccaagctgccttcagcgcagtagtacactatgatctcccctggaaccctaccaggctcgatcaaagggagggccgaattgaccgatatggtcaacgatcaccagaggtccgagtgcttacattgtatggggaggataacaggatagatactctgatactggatgttttgatccgaaagcatcggctgatccgggctaccttgggaatgggtgtccccgctcccgacgaggcagaaggattgcttgacgtgctgttggcgcgagtactggaacccgaacgaagaggttctattcagccattgcttctggatgaagtgcaggcttttgatttgaaatggcgcgatgcggctgaaaacgaaaaaaggtcaaggtcacgattcgcccagaactctataaggcccgaagaagtagcaggggaactcgcagcggtacgggaagcgctcggagacgctcgagccgctcaggacttcgttcttgatgcactgcgaggggccggtgttcaggtgacgccgcgccccgacggaagcttcgaagcggaccccacccaagccgatgtagcaccggaggtccgcgactttctgcggggagcaaggcgcttcagatttgacgcacgggtagaacgaggtgtgacgcccttggcgcggaaccacccattggtcgagcaacttgcaagcactgtactgggtcaggctctggagtctccgcaggaggccgcagccaagcgcgtaggcgtcattcggacctctggcgtaagtactcagaccactcttttgctccttcgatggagatttcatctttccggacgaaagggaaaccgatcttggcaaactcttgctgaagaacttgatcttctggcttacgcaggaagggcagaggatccgcagtggttggacgctgaggccaccagagctttgctcgatctgacccctcagggtaacttggatccggtgcagaaagaggaacgccttactcggacgcttgagggacttagcgctttggagggggttttggaccagcgaggaagggatagagccgcagctctgcttgacgctcacgagagagtacggggagcagcgcgagggcaaggggtgacctattctgcggagcctcctggccccccggatctgcttggtgtctatctctttctccccgcaccaagactcggaggcctcgcctagtaactcgaggttaacttgt

SEQ ID NO: 261 - DNA, 1769 bp, Artificial Sequence
  Description of Artificial Sequence: Synthetic polynucleotide
ggtgtcgtgaggatccatgccgaaaaagaaacggaaggtggaggatccaaagaaaaaacgcaaagttggcagcggcagcatgatagccgtggaagagtggcaacctgcggacggactgacccttgagcctaatgcaaagagggctgcgaaggctagaaagaggtgcctggccctgacagcgggtcccggtgccggaaagacagagatgctcgcacaacgcgccgacttcttgttgaggaccggaacctgtcggtaccccaagaggatactggccatctcattcaaagtggatgcaagtagaaacctgaaggacagagtggagaggaggtgcggctatgatttggcgtcaaggtttgacagttatactttccacgcgttcgccaaaaggatcatcgaccgctttaggccggtgctgacaggcaaggacgccctcgacgcaggctacaccatcgtggataagaagaatggcccctctaggacccagatcgagttcggcgaccttgtcccccttgccatacaaatcctgcaatcaagcaaaattgcacgaaacgcgatccgccaaacttacagcgacatcttcctggatgagtttcaggactgtacaaacctgcagtacgacttggtaaaacttgcgttccagggtacgtcaatacggctgacggctgttggcgataccaagcagaagataatggcctgggctggagccctggacggcattttccagacgtttgccaacgatttcaacgccgtgtccctgaacatgtataggaatttcagaagcaagccacaactgctcagggttcaaaatgaaattatcaggaagttggaccccgattccgtgatgcctgacgaacaacttgacggtgatgaaggcgaggtctatgcgtggaggttcgaggatagctgcaaggaagccgtgtatcttgcggaccttatcaatggctggatcaacaccgaacagctgcccccagcggagatcgccgtactggtcagcaaacagctcgacctctatgtcgaccacttgatgactgagctcgaggctcggggaatcccctacaggaacgagcagcagcttcaagacatcaccatagagccggcagctagactcattgtggactacttgagttgcctctacggcaagagagagccgaaagcatggatccggctcatgaaccagctgatcccattcgcggacgaggagatccaatctagtgctcgaaaggacctcgaccagttgataaagaagcagagaaaaagggtgagcgacgcgaagcacaccgattcacctttcagcgattgggcacaactcgcaattgaattcctgaagtacataggcagtaagatgctggtggcactgagtccagattacgagacgcgcgagaggctgaatgacgtgatcagggaaactttcgcgaggatcaaggaactgttgaagagcgagcccgacctgcccaaggcgctgggccggtttgccgatgaccaggcggtgcgaatactgaccatccacaagagcaagggcctggaattcgacagtgtgatcatcatggccgtcgagaacgagatattcttcgggaaccaggacgagaataggtgcgctttcttcgtaggtgtgagccgagcaaaaaggaggttgatacttacccacgccgaccagagggaaaggccagcgtctgccaagcgatggaatgttagtagaaccgctcagactgagtacattagttacgtcacccctttcgtgaggccacagtagtaactcgaggttaacttgt

SEQ ID NO: 262 - DNA, 2603 bp, Artificial Sequence
  Description of Artificial Sequence: Synthetic polynucleotide
ggtgtcgtgaggatccatgccgaaaaagaaaaggaaagtggaggaccccaaaaaaaagcggaaggtcgggagtggctccgtggccgctttgaagcgctactttaatgacaagaacctgatcgtgataggctactctggcagggacaagagcctgatgagtgcgcttaccgaggctttctctgagaagggctctggccgcatctactggtgcggctacggcagccacatttcccccgaggtggaaagcttgttgaggaccgcgcgagaggcaaaccgcgacgcctactatatcgacaccgatgggttcgacaaaaccatgttcagcctggtaataaactgcttccaggcggatatcgaaaagaagaaagagataatgagcatcctggagtctgctcccgaggacaacgataccagcccgttctcaattcacatcaccaggacggataaataccttaagtccaacctctacccgatcatctttcctaaggagctgtttcagtttgagatagaatatcatgagggcgaacgaccatggaccctgctgagagagatcaccaaagaccagaacatcatcgccgtgccctacaagcaaaaagtctacgccttgtcaacgggatcagctatcaacaacgtgtttggtagccggttgaaatcagatatagagaggattcccgtgtctatggatgacattgagcgcaagtctagttacagggagctcttcctgagggccacccttcagtctatagccattataaggggcctgaacgtggacatacgacacaataccctttggcggagcgacatctttaggaacgacaatggcaccctcatccacgaagcgatcgagtgttccctggtgtttgtgccccaacagaagtatgccctgttgagcttgaggcccaccatctacatagagaactctcatacggttagcaaggagaaaaagcaggagtacgccaggatctacctggataagatgtggaataaagcgtacagcacgaagttggcccagtgggaatctataatctttggagacacgaggctcgccttcgaggtgccgcaaaattcaggatccgggtttaagtttctgataagccacaactgcggcttcagcgaaatccagtatcaagacaacaccgaaaggggatacagtagcaagagctacgacaacaagaggacgatctataggggcttgcagctgaaggaacccgagctggaatttgtcaatacgtttgcagaccggcccttcctggacagcaaccccatgcgaggcctgagcaatcacaggccgtacgacagctggcagaaagacgttctcttgcagaacgtgcggttgggcgtgatttgcccgaacacgcacaccgaccgattccactcttttctgcagcagcttaacaccacaattcaagccaatgacgatagcgactacattcagtcctacaccggtttccatagcatttacaagactctgctggaaatccccgataacgggaccgacaaatggataaacatcgaggatacccccaaggacaccatcagtctggttcagagtatatgtcaccaagcgaaccgactggccgacaagtacccgggcatcgtggtggtgattttcatccccgcattttggtctatccatcgacagttcaaacacaacggggagagcttcgatttgcacaactacatcaaggcctacgccgcacaacatagcttcactacccaaatcattgaggaaaagacgctgcgcgaccacatggtctgcgaaatttgttggtggctgtcactcgcactgttcgttaaggctatgcgaatcccgtgggcactggccaatttggactctgacaccgcttacgcgggtatagggtactcagtgaagaccaacagcaaaggcaacgtcgacatagtgcttggatgttcacatatatacaacgcaaagggccagggtctcagatacaaactctctaaggtcgagcagccccaattcgatggcaagaaaaatccttaccttacgtatgaagaggccttcaagtttggaattaccatacgcgagttgttcgtcaaaagtatggaccggcttcccaggagggttgtgattcacaagcggacgccgttcaaaaaggaggaaatagagggaatcactcacgcgttgactcaggctggcattaaggacatcgatctcattacgatcaattacgagtacgacgccaagttcatagcgcagaaggtatactatgacaacatcagcgacgattcatatcccgtaagtaggggcacctgcatcaaattgtccagccgaaatgcgctgctgtggacacacggcgtggttccctcaatccgggagagacgacgctactaccccggtgggcgctgtattcccgcacccctgaagataacaaaatactacggtaaaggcgatcttccgacaatcgccagcgagattattggatttactaagatgaattggaacagttttaatctgtacacgaaactgcccgccaccatagatacgagcaatacattggcgcaggtcggcaatctgttgcatcagtataacggcgcaacttacgactaccgatatttcatctagtaactcgaggttaacttgt

SEQ ID NO: 263 - DNA, 2390 bp, Artificial Sequence
  Description of Artificial Sequence: Synthetic polynucleotide
ggtgtcgtgaggatccatgcccaaaaagaagagaaaggtagaggatcccaagaagaaacgaaaagtaggcagcggcagtatggtcgcgctgaggctgaacggcgtacccatcttgtgcgccgctgacgtaaccgtggccgtggcgaagttgccgtacacgaaggagagcctggacgagttgaggaaggagcatgcggggaggtatttgattaggagaggcggagatgacgggcaggaaatcatgtctgttcccttgcttgctgatgctccgcagctgagcgatgccgttgtggaagttaagctgtcagaagcccactggttgctcgcctcactcgcggtggaggccctcaccaggttgttcacagaacttggtagacctatcctgcggtcccggccattgcggctgctctcccaaaagccggccaatctttttccggagaacgtcggactgccagactggctgcaaaggagggttgtgctggatttggagactaggaagatctggcggcaggatggagacccgacattggtgctgctgtgcgatgtgcggactcaaaactttatcgacgtgccaacggataaactgatggccaccggcgtaagcgttatgggtcgctacgttagccgaatggtgagctctgatgatccccggatcacctcacatctgaagctcgccggcagggtcattagcatagagggcgaccgactgctcctcgccgactttggcgagggaccggatagtataagcattgctcatgcctatctggagagacgacgggaaaatgtcgactggtgtgttcaacagctgaaccccgcgaaagcagggcaaatcctgatgagcgtgcaggccgaggctgcgaaattcttgaacggacctggccgattcgagctgatcaagaggacattcgattacctgcgcacgcagagtatagagcttgtgcccgacgtgaagctggagttgggggacttgattggcatgggagccgcacgctggcccttccgccaggaaacaattaagaagcctaccctggtgtttgatccgtctggtgtcaagaccgatacctggaacgagcgagggcttgacaaacacggaccctacgaccagaggaccttcagccccaaggaaatgaggatcgccgttatctgcagggaagcagacgaaggtcgggttgaaggatttctggccaagtttctggacgggatgccacacgttatcgtcggggagaaccgaaaaccctatgaaaagggattcataaggaggttcgccctgagtgccccgaaggtgcacactttcaccgctaagtcttctagtgtgccggactacctgaatgcgtgccgagcggccctgaagtttgcccacgaccaaggctttgaatggagcttggcaatcgcgcaaatcgacaaggactttcgggaactcctcggtcctgacaatccctacttcgcgatcaaggccgcgtttctcaagcagagggtgcccatccaggagttgacgctcgagacaatgagcacccccgacaggcagctggtgtacattttgaataacataagcctcgcaagctacgccaagatcggcggcattccgtggctgcttaagagcggtcctaccgtgggccacgagctggtcattggtattggtagccagaccgttagcagtagtcgattgggcgagaagcaacgggtggtgggcattaccaccgtattcacccacgatggcagataccttttggacgacaggacgcgagccgtgccatacggcgagtacgaagcagctttgtccgagacgctgaccagggccatagagagggtaaggacggaagataactggaggtcaaccgacgcggtgcgacttgtattccacgtgttccagcaaatcaaagactacgaggccgacgcagtggggaaactggtcgagaatctcggcttcagcgatgtcaagtacgcctttgtgcatgtcgttgacagccacccctacaccctgtttgacgaacacatgccaggcgttaagtttggctacgagatgaagggcgcctacgcacctgagagaggcctgtgcatcagtcttggcagggacgaacgcctcctcagctttaccgggtctagggaggttaaacaaacccatcatggcctcccaaggccaacccttcttcgactgcataggaacagtaccttccgggacatgacctacatcgccaggcaggctttcgacttcgcaaaccactcatggaggatgctcaccccagcgcccctccccatcaccatccactacgccgaactcatcgcccggttgttggctggtctgaaagacacacccggctgggacgaggacacaatgctcggcccagtaggtagaacccgatggtttctgtagtaactcgaggttaacttgt

SEQ ID NO: 264 - DNA, 2342 bp, Artificial Sequence
  Description of Artificial Sequence: Synthetic polynucleotide
ggtgtcgtgaggatccatgccaaagaaaaaacggaaggtcgaggatcccaaaaaaaagagaaaagtcggtagcggcagcatgaactacacagccgccaacacggccaacagcccattgtttctcagcgagattagcagccttaccttgaaaaacagctgcctcaactgcttcaaactgaattaccagctgactcgcgaaataggcaataggttcggctggcagttcagtaggaagttccctaacgttgtggtggtgttcgaggacaactgtttctgggttctcgctaaagatgagaagagcttgccctctcctcaacagtggaaggaggctctgagcgacatccaggaagtgctgcgagaggatatcggagaccactactacagcatccactggcttaaagacttccagatcaccgccttggtgaccgcccagctcgccgtgcgaattctgaaaatcttcggtaaattcagctaccccatcgtgttccccaaggacagtgaaattagtgagaatcaagtgcaagtaaggcgagaagtcaacttctgggccgagatcattaacgataccgaccccgccatttgcctcaccatcgaaagcagcatcgtctattccggcgatctcgagcagttctacgaaaatcacccgtacaggcaagacgccgtgaagctgctggtgggcctgaaagttaagaccattgagaccaacggcaccgctaagatcatcaaaatcgctggcactataggggaaaagcgcgaatacctgttgactaaggccacgggaagcatatcccggcgaaagttggaggaagcccacctcgcacaacccgtggttgcggtgcagtttggtaaaaaccctcaggagtacatataccccctggctgccctcaaaccttgcatgaccgacaaggatgagagcctgttccaggtcaattacggcgacctcctgaagaaaaccaagatcttctacgctgaacgacagaaattgcttaaactgtacaagcaggaggcgcagaagactttgaataacttcggttttcagcttcgggaaaggtccatcaatagcagggaaaatccagacttcttctggacgcccccaatttcattggagcagacccccatcctgtttgggaagggtgagcgcggtgaaaagagggagaccctcaagggcctttcaaagggcggagtctacaaaaggcacagggagtacgttgatcctgccaggaaaattaggctggccatccttaaaccggactcttttaaagtgggcgacttcagggagcagctggagaagcgactcaagctgtataagttcgagacgattctcccccctgagaaccaaatcaatttttctgtggagggtgttgggagcgaaaaaagggcccgactggaagaagccgtagaccagttgataggtggcgagatccccgtggacatcgccctcgtctttctgccccaggaggaccggaacgcggacaacaccgaggaaggctccttgtatagctggatcaaaaagaaattcttggatcggggggtgataacacagatgatatatgagaaaactctcaacaataagagcaactacaataacatcctgcaccaggtggttcccggcatattggcaaagctcggaaacctgccgtatgtgctggccgagcctcttgaaatcgccgactacttcatcggcctggacgtcggaaggatgcctaagaagaatctccctggttcactgaacgtgtgcgcgtccgttaggctctacggaaagcaaggtgaattcgtccgatgtagagtcgaagatagcttgaccgagggggaggaaatcccccaaaggattcttgagaattgtctgccgcaggcagaacttaagaaccagaccgtcctgatctacagggacgggaaattccagggtaaggaggtggaaaaccttttggctcgggcacgagccatcaacgccaagttcatcctggtagagtgctacaagaccggcagcccgagactttacaatttcgaacaaaagcagattaatagccccagcaaggggctggcgcttgcattgagcaaccgggaggtcatcctcatcaccagccacgttagcgaacagatcggcgtgcctcggcctctccgcctgaaggtgcacgaactgggagaacaggtgaacctcaagcaacttgtggacacgaccctgaaactgactctgctgcattatggctctctgaaggaacctcggcttccaatccccttgtacggagccgacgccatcgcgtataggaggttgcaaggaatctatccaagcctgctggaggacgactgtcagttctggttgtagtaactcgaggttaacttgt

SEQ ID NO: 265 - DNA, 2342 bp, Artificial Sequence
  Description of Artificial Sequence: Synthetic polynucleotide
ggtgtcgtgaggatccatgccgaaaaaaaagcgcaaggtggaggatccaaaaaagaaacggaaagtgggatctggctccatgaactacacagaggccaagaccgccaatagccccttgttccttagcgagattagtagtttgacacttaagaatagctgcctgaattgttttaagctgaaccatcaggtcacccggaaaataggcaacaggttctcttggcagttcagccacaagttccctgacgtcgtggtagtgttcgaggacaattgcttttgggtgctggctaaagatgaaaagagtttgcctagtccacagcagtggaaggaagcactgtcagacatacaggaagtgctgagggaagacattggggaccactactacagcattcactggttgaaagacttccagataaccgccctggtcaccgcgcagctggctgtgcggattttgaagatatttgggaagtttagctacccgatcgtgttccccaaggacagtcagatctctgaaaaccaggtgcaggtgcgaagggaagtggatttctgggctgagataatcaacgacacggacccagcaatatgcctgacggtggaaagcagcatcgtttactctggcgacttggaacagttttacgaaaatcatccgtaccgacaggacgccgtgaaacttctcgtagggctgaaagtgaaaactatcgaaaccaacggcatcgcgaagattatcaaaattgccgggaccatcggagaaaagcgggaggaactgctgaccaaggcaaccgggtccataagcaggcgcaaattggaggaggcacacctgggccaacctgtggtggccgtgcagttcggcaagaatccgagagaatacatctatccccttgccgcgctcaaaccgtgtatgaccgacaaagacgagagcctgtttcaagtgaactatggcgagcttctgaagaagactaagattttctacgccgaacggcaggagttgctgaaattgtataaacaggaggcgcagaagacgctgaacaacttcggcttccagctccgggagcggtcaatcaatagcagggagaaccccgactttttctggaccccctcaatttcccttgaacaaacgcccatcttgtttggcaaaggtgagcgaggtgagaaacgagagaccttgaaaggcttgagcaaaggcggcgtgtacaagagacatagggagtacgtcgaccccgcgagaaagattaggctggccatcctgaagccggccaatctcaaggttggggattttagggagcagctcgagaagcgactgaagctctataagttcgagaccatccttccccccgagaatcaaatcaattttagcgtagagggcgtgggctatgaaaaacgagcccgcttggaagaggccgtggaccaactgattaggggggagatacccgtggatatcgctcttgtctttcttccgcaggaggaccgaaacgccgacaacaccgaggaggggagcctttactcatggatcaagaagaagttccttgacagggttgtgataacgcaaatgatctatgagaaaacgcttaactataagaacaattacaagaacatcctcgatcaggtggtgcctggaatccttgcgaaacttggtaatctgccttacgtgctcgcagagccactggaaatcgccgactacttcattggcctggatgtgggtcgcatgcctaagaaaaacctccccgggtcacttaacgtgtgcgcgtccgtaaggttgtacgggaagcagggcgagtttgtgcggtgccgagtcgaagatagtctcaccgaaggtgaagagatcccccagagaatcctggagaattgtctgccccaagccgagttgaagaaccagaccgtgctgatatacagggacggtaagttccagggcaaggaggtggataacttgctggcccgagccagggccattaagagcaaattcatacttgtcgaatgctataaaacgggcatccccagactgtataacttcaagcaaaaacagatcgacgcgcccagtaagggcctggcgttcgctctgagtaacagggaggtgatcctgatcacgtcccaggttagcgaaaagatcggcgtgccgcgacctctgaggcttaaggtacatgagctgggagagcaggtaaatctgaagcaactggtggacaccacactcaagctgaccctgctccactatgggtctcttaaggacccgaggctgcccatccccctttacggcgctgacatcatcgcgtataggaggttgcagggaatatatccctctttgctggaggacgattgtcagttctggctgtagtaactcgaggttaacttgt

SEQ ID NO: 266 - DNA, 2624 bp, Artificial Sequence
  Description of Artificial Sequence: Synthetic polynucleotide
ggtgtcgtgaggatccatgcctaagaagaaaagaaaggtggaagatccaaagaaaaaacgcaaggtgggtagcggctccatgactaacaaaaccaaacaaaaaagcaggaagcagaggtccctcatagaatttcttaaggtgaagaagatcaacaaggaagatggtaagaaccataacctgatcaagtatagcaccgaacggatcgatacaggagtgacccagagcctcattgacatcaatatatccagtaacatccttaagctgcggggcagcattgctcaagaggtgttcaaacggaaaattggcgtttactacgggcttgggaagtattacgttgccgaaaacaagctgaagaacaccgatcgaatggatttcttgaagagggtctacgagaccttcccctataactacctcgataaacaggacccgcacagcaagatcagcttttacgagtactacacattccagaagtccatcgacaaagacgtgataaacctgcttgagctgcagaagataaacgagtatagttgggacatactggacccacacatcgccacgcgccttctcacaagctatgtgaagctttacttgggcgactacttgaagccaatcctgtcctctttcgagtacgtccgggctcgaatcaagacaaagcaaaagaccgttccaatcaaaatccccgtgaccaagaagttcgagatccgaactttggggtacgacccgacgcagagcgaaattactctcgccataaaacgacacgccagcatgaacgctgtgctgttgagcagctttccccccgacatcctcgcggttgtgataactaagctcaaacgcctcgtgaacgaggccgtgaagcaagactaccgaaaggtcagaatatactccgagacccagccggggagcggtactgccgcagttgttgaaatcatcagcggcagccaaaacgtgatgaagtttctcgaagagcatccgaagggggccatccacgttgaaaagcgacttaaagagctgggtaaatcactgcaggaggtccggtaccttcttatcggcgtctatgacaacaacgtcagcctggagcgggcaaaaaaagacgaaagataccactactacttcaccgagcataacgcttaccttgtacttacgcccgaggtgcaaaaggcgctctttggcaagttgatcgacgactggaagacaagcattctgaatgagtaccaaaataagctccacgagatcacgagtcttgggatgtttaagcatttggagaccatacggggcatcccggtttccttgaaagagaggcttgtggtccgcaccagcgagggcttgcaaaccgtagatgacattagggacattttgaccaaccccaagattcttagtaatatgttgcctatatccgaggacgcgctcaaggagacgcgaaagcataaactgcgaatcaccctgttctgtccggagaagtttagtgagaggattcaccggactattttctacgacaaattgaaccagtttcgagacggtctgcttagcaacagcttcgcaagcgtggacgaaatcgaattgttccaggtcaaaggcgaaaactctagcgattatgaggagatcatgaaggacgctggccttgataaaatccacgattataccctggcggtcatcatatttcccgaacattatagtaagcgcaaccttgagttgcgcatcttttacaactggctgaaaatgcggttctactcagagaacaagccactggttttccagggcgctcggattgacagcgtcttcggccggtatgcgaagtacgcatcatacaacctcatcttgcagatcccacctaaattgggcatctacccgtactcactggaggagcacgaggactatgactacatcatcggcattgattacacctattggtacgagagagatacgcctagtctgggcggtggcgccgtgttgaccagcccgtcagggctgattgagagcatataccccatcgcactcccgagccgcactgaatccctcaacatgtccaagatactgagcgaatggttcacgcgaacagtcaaaacgaaccggcatatcatagataagggccacgtgaccgtgcttatctccagggacggcatgattcctaagtacgaacgccagacaatccaggagttcctgagtgaatatagcggcgacatgggcatgaccatagaggcagtagaagttaggaaacgcatcgccgtgaggacctgggctacacaagagcccgtggcctactacagcccgataaaggttggcgactgtacctactatctggtcgacgcgcacaccggatacccgctgggggagaaagggaaccgaaccttctacagctcaccctatctcataggaagtttttacaggttcgaaaagggcaaatcctcccccgtgccaggtagcgcaaagaagcacgtgatcgaaagcctgataagacttcaaaaaatcaattacgccaccacccgcatggataacatcaagttgcccctgcccgtcgacatcacccacaaactcattaactttatccgggacaccaagatggaaatcaagggggtcggtatcccaaacagtctctttatgatatagtaactcgaggttaacttgt

SEQ ID NO: 267 - DNA, 1934 bp, Artificial Sequence
  Description of Artificial Sequence: Synthetic polynucleotide
ggtgtcgtgaggatccatgccgaaaaagaaacggaaggtagaggaccccaagaaaaagcggaaagttgggagtggaagcatgccgttcaatagcaacctgatcttcgtgaagctcgacgacctcaagagagcctttctcgagggcgtccacagtggtcacgccgtggtgtatgaggtgagcgagggactgagcaccgaggatctgaagaaaaggcttatcaaggccagcgtgatgtaccactataggtatggaaggaacgtgtttgtcttcggcgtcaaggagggcactaaggttgacgatcttgtaccaggccgacgactcggcgagcacgaggtgaaggaggttctcaagggcatcccgtctaacaacctggtgtccatgatgagcgccatgctcaattaccagctctctgtgcttctcaccagcaagggcttccagtatagctacgaagagatgcggaggggcaagtatctgtgtgtcagcaactattacggcaagctgatacggaaccccgtgaaggtttgcctcaaggtaaatgtcataaggagcctcattgacgagcaggatcagtacctgcccatcgcgcttaactacagggtgaagaagagcaggcggcttagccccgaagtaatgaatgagatccacgcggagttcatggaggccttccccagctacctcaacgacctgaaaatcataactcgcgtcttgaacgacgatatggtgaggaacagggaactgaaattcctggagatcgagtacaaaccccctgctatcattacgttccggtttcgaggcaacagcaccggcgaaaacgtgaccgacattctgaagctgggcccctacttcctgcctggggaggaggagaagatcgatgtggtctttgtgtacgaaaatgctctcgctagccaggcgaagaaactcaccaaggttttggaggataccatcaaggacgggctgggcataaagctgaacatagacgacgaacataagttcagccacgacaagccgctgggcgacgttattaagctggtgcgcgaccgattcatcaacagcgggagttgtctgctggtccttagcaaggagaaccgcctcggtcctatcttcatgagcattaaaccgctcacgctcaagaagaacttctacttcaagtctcaatttatcaccaacgaaacgattagcaaactggactcttatgcggtcaaagccaatatcgtgaatagcatcctgttcagggttgaaggtaccccgtacatgcccgttctgcggggcaatatagacgtactggcaaacaatttgttcgtgggcatcgccctgagtaagcctctgaggaagggctacaccaaaggaggcatagccctcatagacccctacagcgcccgaattatcacaagggccatcgtgttgaagcgcaagatgaggagcggcaaattcgaagcctcagacatgcacgagatcgtgtccaacatcaaaggcgtgctgaaggactacaaggagctgtacaacgtcaacgaacttgttatacatatctccaagtttctgagcgatgacgaatacggccttttttacgagtacttgcaggaccttaatgtcaacgtgcgactcctgagcatcaggaagagggacgacattacactggttagggacgggaggatggacagcctgaccatgatcaagcgcggcaagagtcatgtcgaggtcatgtattggcctcacgaaagggcctaccacccccttactatcaggatctacggcgacaatgtggacagggacgtgatgatgcgacacctgaggtttatcgagctgctccggcacatgtactacccggccagcagccgcttcatagttgagcccgcgaccattagctacagcaggagggtcgccagatttgccccctggctttcagacaatacctagtaactcgaggttaacttgt

SEQ ID NO: 268 - DNA, 2609 bp, Artificial Sequence
  Description of Artificial Sequence: Synthetic polynucleotide
ggtgtcgtgaggatccatgcccaaaaagaagcgcaaggtagaagacccaaagaagaaacggaaagtgggaagcggctcaatggaagtgtcccccttcttcaacgaactgttcaagtactacatatttctgttttttggtttcaaggtgaacatcgtgaaatcacattaccagagcattaagaagcacaagataatattctattccggtgggatcatggacgagtattacactaacgccttccccatcaacaaatactttatcaaccgcatcatctctgaaaactgcatccgctgcctgtgcaaaataaccaagctcgagaaaaaagagaagatcgaggagttgctttactctatcagcgccaccctggggggcatttacatcgacgattacaacccaatgaagaataagttcagcttctacatttggaagggaatcctgaataagaagattaaatcctacgggtctgaatggctcattaacaagatgaaaaacatgggctttaaggatccggaaaacaagacgctgttgaactatgtgaaaaaaaagtacgagaaagacataaagttcgacatcataaagaaagagaagatagaatggagtaacctcgactgggagataaaggaaaagatagtgctgggcgccataaaaactcaccctaccattcgcaaactgattgaatacaagaatgagaaattcattgacaaaattggaaagaaaattctgacttactttagcatcacaatcaccagcgacgagaacgagaattactttctgatcgtcaagcccaagcataagatcatcagctcagagacaatttacaacatgctgaagaacaacaaaatcgactttaaaactcttgagaggaagctgctgaacggcagcgccctgataaccaccagtagggcagtcggcagacggaaatacgtcaaaatcaaaaaaatcatatcccccaaggagaaggagtattggcaacatacccaggacatcaatgagcactacgaaaaggagggcgtcccgatcagcgtcggcggtgacgacatccactgctatatcttcatcggggaagacgattacgcctaccacacgaagaactccttgctctacgagggtgtgacggaggacgtgcagaaaatactcttggatatgggtaagttcctggaggagctggagacggcaaaatctatcctcaagcagggcaacctcatagacttcagtcgcgaattcctcaacattagcacgaaggacgactacacccttactctcctgagcacactgtccgatatcaaagtgaagcttaagaccgagtctggtatcatcacaggcgactaccagaaacttagggagatctttgactggatcttcgacaagagctttaaccccttgaagcctaagaattgctaccttccgctgagtattccccccatactgaatgacaagaaaaagatcggcgtgtacatcttctatagcaatattagcgaccccgagcttaggtttatcgaagggatctttaagaaactgggcctgatatgcgccatcaataagagtgtgccaaaaattgaggttaaactcaagaaggaagtggactttgaggactacgccaacagcaggatcataatcacccagaccgtactgagcaatctcgaggatggcgagcagccgttcctcatatgtataagtcccttgctgccgaataacgagttcgatgaactcaaaatgcatctgttctctcacccgcagctgatatttcaccaattcatgtatccgttcaaccttcgaaagtgccttgagaaagaatcattcaagaaacccttcatcaactcaatcctgtctcagttctttcacaaaatgggcatgtacctctttagtctgtctgacgagctggggaactacgacttcattattggttacgacataagtagggaaaaggatgacatcgggaagataaaaggtatcggcggctccgcgatcatctacaacaattacggccatgtcaagtcaatcataacgttcgacgacgtagggtctagcgagataggcaggtacgacctcctgttcgcgcaggtgcacagcgaactgataccccacctgaatctgaacaataagcggaaaattaagattctgcttctcaaagacgggcggattttcaaaaaggaactcgaaaagctcagccaaatcagcaagaagtataacttcgagatcacctacattgacgttcgcaagagcacgctgctccggttctggggtgtgcggaggggcaaagtggtgcccgagtataagaatagctacgggaagttcggacgcgcatactatattagtagccattactacaaccgctttttcaagcaaccaatcgcaatcgtggagaagtaccacatagacgagggcaattacaaacgcgtggaaatagaggagaatgatattaagcagctggttctgttgaccaagattaactacagccaactgatgccagataagatgcggctgcccgcacccgttcactacgcacacaagcacgtgaacgccgtgcgacggggctggaagatcaaggacgtctctatactgaggagcgggtgtcttcctacgatctagtaactcgaggttaacttgt

SEQ ID NO: 269 - DNA, 2285 bp, Artificial Sequence
  Description of Artificial Sequence: Synthetic polynucleotide
ggtgtcgtgaggatccatgcctaagaagaaacggaaggtggaagatccaaaaaagaagcgaaaggttggtagcggctcaatggcctatagccttaacgctttcgaactggaaattcccgacattgacgccgacctctacaaagttgaccctcaaccctctgatgacccatatcgaatcctggggggtttggaacggtccttcgagcaacaactggacggcaaggcccagaaatggaaacaggcggaggacggagattggtatatcgccgtgataggcgcgtcagaaaggaaaactatcgagtccccctccagcggtacgagggcaggctacaccaccacgcatacgctggatccgagtagcttttgggacaggatggtgttgcaaagggcaattagcgactctgtacgatggtacatgaccaactatcaggacttttggtatcatgaggatgcggatgcactcttttatccttctcctagaggcaaagtggacgagtacgacgtctacaccggatttagtcatagggtcgagttttatgacagcccacaacttgtcgtgcgcagcgtcactaagttcatctccagtgaaagcctggcggaccggatcaaccatcagggcacagaagaagcaacggaaaaatacggtggtgagaactttaggctggacaggccggaaccaaccaaatgtactttgcacggcatctcaaccgagcgaacggtaagtgacaagacgatagattttggtgacgagatgctgtccgtgttggagtttgcacaaagaaaatatggcagcgagtgggcggacaaaatcgatcccgacgaaccattggtgcagatacgcttcgggaacagcgacccctacgacaccgctccgagcctgctgaatgcgagccctgaggagctgaatcgcaggctgaccagcgaggcagccctcagcgcacaagaaaggcagaaggccatacagaacttcatcggcaggatacactacatccaggttgaagacgagaaggtgagcgtcagcgatgacggcgtacggcccaccgagcagggcgacttcgactaccccgatcttgcgtttggcaatgacgaggtgctcagcaccggcgtcccgaacgcggtagatcctagccaggaggtgcacccgggcaactggcgatggataatcagggactacctggaggaatacggcttctgggagtcacaacgaaagctgtctgagatcgtgctggtgtacccgagaggcgaagaaagacgggcagagaacctgtaccaggacgttagggagaagctttcagagataggaggcgttcagatcaggagcgatccacatcgcgtgtgttacaccgatcaggtggagttcgacgaatgggtggctgaattcggtgactcaatcgacggtgttcttggattgattgagggagatggagacgaatactacgaaatcatagatgcatttggcggagcaccgacccagtacgtcaacactagcacctactcagagcacagaggggcgagcgacgacgtgatctttaacactgcttgcggactggccgtgaagttgggcgcatatccttttggcctggccaacgacctgaacagtgacgtgtacctcggccttagcgtggcaggggatagaagcacaacggccaccgccgttgccatagacggaagagatgggaggattctctatcaaacagaggaacccctgggccagggtagcagcacagtaagcgagggctatcccgctaagcgaatcatccagaggagcctgaagaccgcctcaagcgcctttgatcgaccaatcgagagcttcgacattcacaggaacggagactttggcgacgctgagctggaaacccttagcagtgaattgcctgcactccaggaccaggaatatgtgcataccgatgtttcatggagcgccgtcgaggtaattgaaaaccacccttacaggctctttagtgaacggggcagcagagctcccgataccggagcctatgctaagctggacgacgagcatgtactggttactacctttggagagccccagatccaccaaggtacgccaaaaccggtcctgtgcaagaggagagcaacgagccaagatcaagacatcaccgccatcggagaggacgtgttcaaactcagcttccttaactggggtagcccaatgatgaagatgaagccacctgttaccactaagattccgaaggaactcaacgagattttcgagaagtgctctagggtgagatacccccccttctagtaactcgaggttaacttgt

SEQ ID NO: 270 - DNA, 2618 bp, Artificial Sequence
  Description of Artificial Sequence: Synthetic polynucleotide
ggtgtcgtgaggatccatgcctaagaaaaaaaggaaggttgaagacccgaagaagaaacgcaaggtcggcagcggaagtatgaagacgcaggatgatatcgcgcacaagcaacccattaccatcgaggtccagatcctgaaggagctcgacaagccaagcccaaaaatggccacccggttcctcgtggccgatagggacggcaacaggtttagcctggctatctggaagaacaacgcactcagcgactatgactggacgattggccagtggtacaggctggaaaacgccagaggaaatgtctttaacggcaaacagtccctcaacggtagcagcaaaatgcgcgccactccacttgaggccagcgaggaggacgaaaccagcacggatgatgtgggacgggtcgacacaatcctgggtaatatgagcccggaccaggcttacctgagcctgtttcccatcagtaggtcttttgataccctgtctgtgtacgagtacagcattgaggcagccgaggcattcgaggatgcgccggacaccgtgacctacaggtgcgctggcaggcttcggagaatcacgggtgcgggggtcgcttatgctggctcaatgaggatcgtgtcaacccgcaaactcccggacaagctcgcggacccctttagcttgagtgaacccacggagagggaactgaacgctacggacgccagggacaggcataggatagagcggcttctgaagagcctcgtgaaggccgccatcgacgatagcacctacgacccataccagatcaaccgaatcagggccaggaccccgagcattaccgctggcgacgggctgttcgaggcgtgctatgaatttgcagcaagggtcgatgtgatgccctccggcgacgccttcgtgggaattgaggtaaggtaccacacgcggagccaggtcactgcagacgtttacgaagacaaaaccgcggaactggtgggcaccatcgtggagcatgacccagagaggtacaacattagcggtacgggccgagtagtgggtttcactgaccaccacttcaccgacgccctcgacgaattgggcggtcttagtttggcggactggtacgcgcagaaggatcgcgtcccagagggggtattggaggcgctgcgagagaaaaatcctaggttggttgatattcagtaccaggaagacgaaccagccagaatccacgtcccggatttgctcagggtagcaccccgcaaggaagttgtcaaggagttggatcccgccttccacagaaggtgggatcgagaggccaagatgttgcccgacaaaaggttcaggcacgccatagagtttgtggatcatctcgggtccctgccggatatagacgccacggtggcacccgagcctttggggccgtcactgtcttacatgagcacagcagtcgacagggagaagaacctgcgcttcaaagatggaaggaccgccaccaccccgtcaagcggcatccggagcggcgtataccaacaaccgacgagcttcgacatcgcctatgtgtaccccaccgagtctgaacaggagagcaagcaattcatttctaacttcgagaacaaactgtcccagtgccagtgcgaaccaactgccgctaggcacgttccttatgaactcggcggcgagctgagttacttggctgtcatcaatgaacttgagagcgtggatgcggtgctcgctgtggtgcctccccgagacgatgaccggataacggccggagacataactgacccctatcccgaattcaagaagggcctcgggaagcagaaaatacccagtcaaatgatcgtgaccgagaacttgggcacaagatgggtgatgaacaatacagccatgggcctgatcgcaggggcaggaggcgttccgtggagggtggatgagatgccgggtgaggccgattgcttcataggactggatgtgactcgcgacccggaaaccggccaacaccttggcgctagtgccaatgtcgtttatgccgacggaaccgttttcgcctctaaaacgcagaccctgcagagtggggaaacgttcgatgagcagagcataatcgacgtgatcaaggatgtattccaggagttcgttaggcgcgaggggcgatcccctgaacacattgttatccatagggatggccggctgtttgaggacgccgacgaaatccaggccccgttcgcggatagcggagtgagcatagacattctggacatcaggaaatctggcgctccgaggattgcccaatacgaggacaacagcttcaagattgacgagaaaggccgacttttcatcagtcaagatgacacgcatggattcatcgccacaacgggaaagccggaatttgatgatagcgacaacctgggcactcccaagactttgagggtagtgaggcgggctggtgacacaccgatgctgactctgctgaagcaggtgtactggcttagcgaggcacatgttggcagtgtgagccgaagcgttcgcctgcctatcacaacttactatgcagatcgctgcgccgaacatgcgcgggaggggtacctgctccatggcgagttgatcgagggtgtgccatatctgtagtaactcgaggttaacttgt

SEQ ID NO: 271 - DNA, 2708 bp, Artificial Sequence
  Description of Artificial Sequence: Synthetic polynucleotide
ggtgtcgtgaggatccatgcccaaaaagaaaaggaaagtggaggatccgaagaaaaagaggaaggtaggctccgggagcatgaagccagtgaacttggatgaaaacagcctcaacgacgtcccggtaggcgacacctatgctgtccgcttcactcttgatgcagtcttcgagaacgaagggcagtatccccggaggaatctgaaattcacagacggagggggggatgaccgaaccatcactatttggaaaaactctgcacccgaggaaatttacgaggcggactatgagcgcggtgcgacgtatcttattaccgccgtcgagtatgacatcgacgaaggtaatgacggcgagcgataccagaatctcacagtccaatcagatgctaccttgctggagatgagcggtccccctagtaccgaagaggccttggaagacggcctcgccgaaaccccagatactagcgccgattcaggtgaccacgggttgacaacctttaggactacagacgacctgccggattatgacgtctatgagtacgagctggtgccgaagcaaggattccggccgtccggagaaaatgccctccgagccacatacagggcacgacgcaaggtccgccagcagttggacgtaacacccgtcgtggtcggcgatgcgtttaagcttgtgtctctggtcaagctggcccacgagcgggtcgagcttccgcgattcaagatcaacgaggttgacgagaggcccatcgtctacgccgatgaggatgacagggatgtgttgggggaaatgctcggtgagatcctcaaggacgcgaaacgggaccagtacgacatccatggcatcgacaaaatactggagccagagcccgtcatagagaaagagggcttcaggctccacgaacggtacaacctgaccgtggaagttctccctagcagggccgcttacctgcacgtggactatcgacatcggatattgagcgacaggaccctggatcaactcgatgaagacgaaatccaccctggcctgcgcgtgaccccctcatatagggacatgggtctgtacgttataggcgttgggccggagacggtgaccgataagctgcatatcgagggcaacaagagcctggtccaataccatcgggaagagccgtgggtggacccggcgaaggtgcaagaaatcaaagacgcagatagggaagtgatctggaccgtgaggcaacggggcgatggcaccgagatggcattcccgccggagctgctcgcgcttcaagggcaccccgaaaatttggcccagttcgccagcgactttgctgaacaacaaaggctcaacacgcgcctttccgctgagcaatgcatcaccaaggctaaaaggtttgtggagcgactcgggcccttgcaattcgacggacacactgtggaattcgagaccaacccgctgttgggcgatcggaacatagccatagatggtctgtttcacccggaagcaaacgtgctgcagtttagcggaggccagaccggcacccacccctcagatgtgacacagctgggcgtgtacgaagccccggaccccttcagggtgtgccacatcaggatggagaagcgggacaaaagaatacagaggggttggagtaccttggagacgaagctggagcagattggagcgcctcccgacagtgtcgaggaggtcacgttcgacgccacaatgagccctgaccagttgggtatggagatagcggccgagataccggacgaccatgattacgacgcggccttctgcacattgccacctaaagacaccggctactttgacaccgcagaccccgagcgagtttacgatgaacttaagaaagtgttggccaccaaagaccttaactcccaattcgcgtatgaagcaacgctggacgagcgctttacaataatcaatatagcactgggtcttgtcgccgcagcgggaggtattccgttcacaatcgagagggcgttgccaggcgatagcgaactccacctgggaatcgatgtaacccaccaatacgacgagtccgcgaatggcaaccacattcacctcgctgctgcgacgacggctatccacgctgatggagctgtactgggctacacctccagccgccctcagtctggggaaaagattccccccaaggagctgaaagagatcatcaagcaagcggtgatgggctttcgcacacgctacgatcgctacccaaatcatataaccatccacagggacgggttcgcaaacgaggacctgtccgaggtagaaaagtttctgacggacctcgacgttgaatatgatgttgtcgagatcaggaagcaggccccagcgcgcgtcttgaaatacagtggtgcccacttcgacacgcctcaaaaggcgaccgccgcaatctacgaagacatcccgaaagcgattgtagcgacgtttggtgaacccgagactctcgctagccgggagtcaaccgggcttccccaaccaatcacggtggaaagggtgcacggagagacccccatcgagacacttgctgcgcaaacctacctgctgagccaagcccacataggcgccagtaacgctacagcacgcttgcccataaccaccatgtatgccgacttggctagtgcagcggcagccaggcaacaccttcccccgaccaacaagctgagggataagatcggattcatctagtaactcgaggttaacttgt

SEQ ID NO: 272 - DNA, 2219 bp, Artificial Sequence
  Description of Artificial Sequence: Synthetic polynucleotide
ggtgtcgtgaggatccatgccaaagaagaagcggaaagtcgaggaccctaaaaagaaacgaaaggttggcagcggtagcatgaagaacctgagatacaaaatcaacgcctacagaatcaaaaaagactatattcccaaggaagtttatagatacaggatccgctccttcatagagaacattaacatatataggttcgtcggtttttacggaggcgtggccctcaatcaatctgagtttatccttccgtacccggtcgaaaatctcgtcctggaatacgacggaaaagatgtaaagcttgagcatatcgacacactgaacctggaggacatcgagaataaggacaaggagaaagccgagaagctggtgaggggatacctgaccagcatatacaagttgaaacccatactctacaagatcctgcgggacgttcgagagagcaagatcattaacgatatcagagtggatcctatacccgactttacagtaaaaaggcacaataacgaatactaccttgtcatcgattttaaccacaccgcgaccgtgttgaaaaatctttgggacttcgtgggaagggacaagctgaaactcgaggattatatcggtaagaaaatcatattcaagcccaacccgaagaagaggtatactataaagagcattgaaaagcagaacaagaaggacattgatgacattgtcgagcacatcatcgagtactacaagtggacggaggaggaaattaagagcaccttcggcgaaatcgactatactcagcccatcatccattgcgagggcatcccctacccgttcgcaccgcaattttgcaatatcgtatttaccatggaagacttggatgagaataccctcaaggacctgcagagctactggaggttgcccaacgagatcaaaggcaacattatcaatcagatcgctaaaaaactgcgatttgtggagaacgagccaatcgaattggaattcattaagttcaataacaccccccttatcgtgaaggacgaaaatggcaaaccaacaaagatatacaccaccaatcgcctcttccgatggaattacgatagtaaatccaaactgtacttgccctacgacatccctgacataatcaagaacaaaacactgacaacgtttgtgctgatcgacgagaatctcaaaaacgtgagtggtaagatcaagagaaaggtctaccaaatgttcaagaattacaataagatcgccagcaagactgagctcccgaaatttgacttcgccaataaatggaaatacttctctaacaacaacatcagggacgtgatccgaaagattaaggatgagttcaacgaggagcttggcttcgcgctcattatcggcaaccgatactatgaaaacgattattacgagaccctgaagatgcaattgttcaacctgaatatcatctcccaaaacattctctgggagaattggtcaaaagacgataataacttcatgacaaacaacctgctcatacaaattatgggcaaactcggaattaagtacttcgcactggacgcaaaagtgaactatgactacatcatggggttggacagcggcctgggcgcattcaaaagcaacagagtgtccgggtgtaccgtgatctatgacagcgaagggaagatccgacggattcaaccaattgacgtgcccagccctggggaaaggatccccattcacctggtagtggagttcctggagaccaagaccgacatcaatatggaaaacaaaaacatcctgttccttcgagacggctttgtgcagaatagtgagagggaggagttgaagaaactgagcaaagagctgaatagtaacatcgaagtgatctcaatccgcaagaataacaagtataaagtctttaccagcgactacggtatcggctccatttttggcaatgatggcatattcctgccacataaaactacattcggaagcaacccggtgaagctcagcacctggctgcgctttaactccgggaatgaggaaaaattgaagataaatgagtctataatgcaacttttgtacgaccttaccaaaatgaactacagcgctctgtacggggagggtaggaaccttcgcatcccggcaccgattcactacgccgacaagtttgtgaaggcccttggaaagaactggaaaatagacgaagagttgctgaagcatggcttcctctacttcatctagtaactcgaggttaacttgt

SEQ ID NO: 273 - DNA, 2336 bp, Artificial Sequence
  Description of Artificial Sequence: Synthetic polynucleotide
ggtgtcgtgaggatccatgcctaagaaaaaaagaaaggtagaggacccgaagaagaagcgcaaggtcggctccggaagcatgagtcaagactctaggagcaccgaggtggagaggcaggccgaaatacaacctggtacctacctgttgaacggccggggggaaattcagttggatgaggttgacgcattccagtacgacctcaaggtgagtggaggcgtggagcagtattgggatcgggaacaattcaccagctctgcagcctactacctggaccaggaacacgggagccctgtcgctgagataggcaaaatgaacgtgctcagcaagacggatttgtctagatcagttagagtgtggcagagaaacgtgactcccatcaataggcagagcgttacactgaccgcagcccaacccgaggaccgagaaaagatcaaatcattcgtgcaaagctgcttcaagagggcagtgccgaccgaaaaatacagctttcgctttctcaacaagattgtcagggatgagcccgagttcaccaccggcagcgaaggcttttctgcacatccgaagcacgacgttaagatacaggtcaccgctgatggcaatgtgcttgtgcacgtggatagcgggttcagcatcaggagcaacagcaccctggacgaaatctactctgaacaggataacccttacggtaagcgcgttgcccacgaccccgagaggtatggtacccagggccaaggcacccttcgcggttggagcgactatcggtacacagaccatattagcgatgcgggtagctctgtgaacgaaatgcacaaaggggtggcggacgaagaatggcggcaacgactcgcagaggagaatccccgacttctgaaagtggagtatggcaacaaaactaggaggcaagccccccatttcctgaggctctcaccgcggatcgagcaggtgcaggatcaggatcgcgagttctatagcaggtttaacagccggagcgcgatgatgcccgacgaaagatttgaactgtctaaagagttcctgcagaacgtgagccgcttgccggtattggacatggaactcgagccgggtccggtgaacagcagttacgagttgctggaaatgcgagaggaaaacaggctggtttttggagggaagcagagggctagagacccgggcagcgggcttagagagaatggggtgtatcaaagtcccagtcagtaccggctgggggtgttgacccccgaacgatggggagagaaggcgagcgagctgatccccctgattgtgtccggcctgaacgatctgagcgcatcagcaggagttcgagcatatggatacgaattgggggacgtcagcaattacacacccgtggttcaggacctccacgaggagacggacgctgtgctcgccgtggtccccaataagggtgtggccgaggattttgggatagacgatccatacaaggagctgaaaagaaccctcctgcggaaagggatacccacccaaatgatgcaaaagtccacggtcgatgaaatcgtgggtcaaaaggcgggaatcggcaatgacaagtttctgaacgcacttagtgcagtcgtggccaaagtgggcggtaccccatggcagatcgatagcctccccgggaaaaccgacgccttcatgggcttggacgtaacttacgacgagagtagcgagcagcacgcaggcgccagtgcaagcgtagtactcgcggatgggacgactttcgcagccgagagcaccacccagcaaggtggcgagaagttcagtgcacggcatgtagaacagttcgtgagggacctcgtcttcgactttgcgggggaacagggccgagacatcgacagactgtgcataatgagagatgggaagatcagcgaggatattgacgccgtaagagagggactcagtggtattgaggcggagatcgacatagttggcatacgaaaatccgggcaacctcgcatagctgagtttgacggtactcggtttcggatcgccgaaaagggcgtgggctttgtggacgccgacagaagccagtctatcatccatgcattcggcaaacccgaaatccacgacgacaatcctgtgggcaccccacgaacctttcgactgaccaaggactctggtcccacagatgtggagaccctgacccgacaggcatactggttgtccgagatccattttggaagccccgttaggtcccctaggctccccgtgccaatagagtacgcagacatggctgctgagtatgttcgggaggagtacgtctcaccagggactgtaatagaagggccagcatacatctagtaactcgaggttaacttgt

SEQ ID NO: 274 - DNA, 2291 bp, Artificial Sequence
  Description of Artificial Sequence: Synthetic polynucleotide
ggtgtcgtgaggatccatgcccaagaagaaaaggaaggtagaggatccaaagaaaaagcggaaggttggaagtggaagcctccccatcgtcctgaacgccttcccacttaaagtacccgaactggagctggaagttaggcaaataccgtacgataaagagacgcttgacggcctcagggctgcgcacaaggccacccacgctttccgcaggcagggcgacaacatactgattttttccggtgatggcacatttcccgcgtctgggacgcctcaaactattgcactgaaggacaatttcggcgtgttctacagcctcgtgaaggatggtcttatccgccaccttgcggggctcgggaggaatcccagcgggttcaaccccatagagttggtgtccgcaaaacccgaagacaacctgctggtccccatactcggcgatgcgtatccttttaaggtgtgcgcgaaatacagcattgacaccagaaccgtgctggggcacccatgtctggtgatcgattgcacgaccaggagggtgttgaaggaaaatggcttgttctttttgaacgctgggttcgacctcgcgggcaggtacgtggtgacggagcaagatgacgggtacaggaaattgctcggcagcgtgagcggctgtaagggtgaaacgctgtacgtgactaggcccgatggccaagtggtgcaggccgaggctaaaaacgtgtacctggaggcatcccgcacaaatttcgacgactatattctgcacacccacagggctcagaaggacgcgatcgttgaacgaatcagacagtccgtttccgtgtttaatgggggcgaaaataagaaagcccgaatcgacacgctgaagaagtatatccagtccaaaaccattcccttgatcgacggcaccaggattgagatccaagattcccctaacatacagaaagactgcggccagatgcaaaaaccggtattcgtctttaacgacaacggcgaggcggactgggcggagaaggggctgacccaatctgggccgtacaccaagaggaccttcgacaggaatgacccctccatttgcgtgatctgcgcccaacatgacaagggacgcgttgagcagttcgtcaggaagttgcttaagggcattccaaactccaaatacttcagcaacggtctcgaggggaagtttaccctgggcactagcagggtagaagtgttcgcgaccgctactgacagcgtagacgcctacaagaacgctattgaagccgcaatacggaagaaggccgacgacggcggcaggtgggacctggccctggttcaagtgaggcagagctttaagaagttgaaagtgaccgagaacccctactaccttggcaaaagtctgttcttcctccaccaggtgcccgtccaggactttaccattgagctgttggctcagtccgactactccctcggctactctctgaataacatggcccttgcatgctacgcgaagatgggcggtgtgccctggctgcttaaatcttcacccaccctcagccatgagcttgtgataggcatcggctccgccaacatcggccaggagagaggagctgataatcagagaattatgggcatcaccactgtgttcagcggagacggcagctatatcgtgagcaatacatctaaggctgttgtccccgaagcttactgcgaggcccttaccgccgtacttggcgaaaccatcgaaaagattcagaagaggatgaactggcagaagggcgataccatcagattgatcttccacgctcaggtcaagaaattcaacaaggaggaaatcgaagcggtcagagccgtcattgagaaatatcgggaataccagatcgagtacacttttctgaagataagcgaaaaccacgggcttcacatgttcgatagtgcaaccgcaggggtgcaaaagggccgacttgcccctccgagggggaagacgttcaagctgagcaaacatgagatgctggtttatctgatagggcagagggagctgcggcaagacaccgatggtcatcccaggggcgtcatccttgatgttcacaaggacagtacattcaaagacatcacctacctttcagcccagctctactcatttgccagccacagctggcgctcttactttcccaaccctatgccagtaaccatttcatacagcgatctgatcgctcgaaaccttggttggctgaaccaactgcccgggtggaacgactccgtgatgatcggaaagatcgggcaaagccagtggttcctgtagtaactcgaggttaacttgt

SEQ ID NO: 275 - DNA, 2216 bp, Artificial Sequence
  Description of Artificial Sequence: Synthetic polynucleotide
ggtgtcgtgaggatccatgcccaaaaaaaagaggaaggtggaggacccgaagaagaagcgcaaagtgggtagcgggtccatgaaagagtttaacgtcattaccgagttcaagaacggcataaacagcaaatctattgagatctacatctacaaaatgatggtccgagatttcgagaagcgacacaatgaaaattacgacgtggtgaaggagctgattaaccttaacaacaactccaccatagtgttctacgagcagtacatcgcctcctttaaggagattgagaaatgggggaacgagcaatacataaatgtggagaagagggctatcaacctggagtccaacgagaagaaaattctggagaggctcctgctgaaggaaatcaaaaataacatagacaataacaagtacaaggtcgtcaaggacagcatatacatcaataagccagtgtacaacgagaagggcatcaaaattgacaggtatttcaatctggacataaacgttgagtcaaacggagacattatcatcgggtttgacatctcccataacttcgagtatatcaacactctggagtatgaaataaagaacaataatatcaagattggggaccgggtaaaggactacttctacaacctgacctatgagtacgtgggcatcgccccctttactatctccgaggaaaacgagtacatgggctgctcaatcgtcgactattatgagaacaagaaccagagctatattgtgaataaactgcctaaagacatgaaggccatcctggtaaagaataataagaactctatatttccctacatcccgagcaggcttaaaaaggtgtgcagattcgaaaaccttccccagaacgtgctgagggactttaacacgagggtgaagcagaagacaaacgaaaaaatgcagttcatggttgacgaagtgatcaacatcgtgaagaattccgagcatatcgacgtcaaaaagaaaaacatgatgtgcgataacattgggtacaagatcgaggacctgcaacagcccgacctgctcttcggtaacgccagggcccagaggtaccccctctatggtctcaaaaacttcggggtgtacgaaaacaagcggatagagatcaaatacttcatagaccccatcctcgccaagtcaaagatgaacttggagaaaatctccaaattttgtgacgagctggaacagtttagcagcaagctgggcgtggggctcaaccgggttaagctgaacaacatagttaatttcaaagaaatccgcatggacaatgaggacattttcagctacgagataagaaagatagtgagcaactataatgaaactaccatcgtaatcctgagcgaggagaacctgaataagtactacaacatcattaagaaaacattcagcggcggaaacgaggtgcccacccagtgcatcggtttcaatacgctgagctacacggaaaaaaacaaagattctatcttcctgaacattctgctgggggtttacgccaagagtggcatccagccctggatcctgaatgagaagttgaacagtgactgctttatcggcctggacgtgtctagggagaataaggtcaataaagcgggagtcatccaggtggtcgggaaagacggcagggtgctcaaaactaaggtgatcagcagcagccaaagcggagagaagatcaagttggagaccctcagggagatcgtgtttgaggcaatcaacagttacgagaatacgtaccggtgcaaacccaaacacattactttccaccgcgatggaatcaaccgcgaggaactggagaacttgaagaacaccatgaccaacctcggtgttgagttcgactacatcgaaattaccaaaggcattaacaggaggatcgccactatcagcgaaggtgaggaatggaagacgattatggggaggtgctactataaggacaacagcgcgtacgtgtgtaccaccaagccttacgagggaatcggcatggccaagcccatccgaatcaggagggtgttcggcacgctcgacatagaaaagattgtcgaagacgcctacaaactgacctttatgcacgttggcgcaattaacaaaatcaggcttcccattactacgtactacgcagacctgagctccacttacggcaatcgggatcttatccccacaaacatcgacactaactgtctgtactttatatagtaactcgaggttaacttgt

SEQ ID NO: 276 - DNA, 3248 bp, Artificial Sequence
  Description of Artificial Sequence: Synthetic polynucleotide
ggtgtcgtgaggatccatgcccaaaaagaaacgaaaggtcgaagaccctaagaaaaagcgcaaggtaggttcaggctctatgtctgtggacgctatgatcaggagtatcggggtcgcacgggaccgcccgcttctcgttttcctcggggcaggtgcctcaatgagcagtggtatgccgtccgccactcaatgtatctgggagtggaaacgagaaatcttcttgacaaacaaccccgacgttgagaagacccagttctccgagctgagccttcccagcgtcagattgcgcatccaagcatggctggatcggcaacgacgctatcccgctcttgatcatcccgacgagtattctacctacataggtgagtgctttgcacgctctgacgaccgcagaatctacttcgagaagtgggtcaaacgctgtagtccgcaccttggataccaactgcttgccgaattggcacggcaggggcttgtggccagcgtttggactactaatttcgatgccttggcggctcgcgcagctacgtccatcaatctcactgcaatcgagattggaattgattcacagcaaagactgtaccgggcgccgggcgaggcggaactggcgtgtgtgagtctgcatggagattatcggtatgatcctttgaaaaacaccgctccagaactcataaaacaagagaaggagctcagagagtcacttgtccaagcgatgagaactcacacagtcctggtttgcggctatagtggtcgggatgagagtgtcatggcagcgttttccgatgcctatgacgcagctcattttaagggtcatcaccccctcttctggacacagtacggcgattatcccgccagtgagcccgtagctggacttcttgcttcaccgctggatcaggaacctgcgaagttccacgtgcctggggcatcattcgatgatcttatgcgcaggatagcactccacgtgagtgacggtgaagcgcgcgagcgggtgcggaagattcttgagaacttcaagacggcaccagttaaccagaagctcccctttgccttgcctagtcttcctgtgacgggtctcgtcaagtcaaacgccattccgttgataccgcctggagagcttatagaatttgatcttgtccggtggccgccgtccggtgaagtttggagcacgctccgggaaataggggatagacacggattcgtagctgccccttttcgcgggaaggtgtatgctctggctacgatagagcaactgacacaagccttcgcggacaatgtaaaggatggcgcgttcaacagggtgccgctgaataatgatgacctccgctacgaggacggaaccgccaatcagctgatgcgacgcgctactgttctggctttggctgggaaagctggatgcgcgaacgatggggatgccattgtgtgggacacgtctcgctcaaaaaccgaaagattggataggcaactttggactgtatacgatgcagtacttctgcagattcggccgctgggaactaagctcgcgctcgtacttaagcctacgctgcgggttacggattcaactggcgaggtagccccgaaagaaattgaacgggcagtcaaggtgcgcgtattgggataccagcataacaaagagttcaaccaggcgaccgacttttggaggaaaaggctcctgccctcaagagatctccttgtcagatttcctgatctggatggtggaatgactttcacgatttcaggtcggccaatattcgcccggctcaccgacgaaaggactgaaactgtcacactgaacgatgcccaagagcgatcagcatctcaagtggggttgcagcttgcagagcctaaactggtgtttgcacgcactgtaggtacgggtcccgcaacggacaccctcccggttagaggattgctgcaaaatagacctttcgatgctaatctgacagacttgggcatcgcgacgaacctgaggatcgcggttattgcgcccgctcgggacgccagaagggtacatgactatcttgggcagctgcatcagcctatagatcctacaaagtgggatgcggactatctgatgaggtttcccggcttcagctccgcttttaaatgccctttggacattccgcagccgggccaggcagcttttgtaacacttgacgagccacacgatgagagtcctcaatcagcgcggacccttgcaggccgaatcacagcggcactgtctgcattgagggcgacggagaatccctctgttacaataatatatattccggcgcgctggcacgcgctgcgagcattcgatctcgaatcagagcaattcaatcttcatgactttgttaaggccgccgcaattccagcgggctgttccacacagtttctggaggagtcaactcttgcaaatggccaacagtgcagagtgcgatggtggcttagcctcgctgtttacgtaaaggcaatgcgcaccccgtgggctttgacgggactcgatagggactctgcctttgtagggctgggcttctctgtaagacgaaagatcgatggcgaaggtcacgtcgcgttgggttgttctcatctttatagcccaaatggtcatggtttgcagttccgcttgagtaagattgataatccgataatgctgcgaaaaaatccttttatgtcctttgacgacgctagaaagttgggcgaaggcatcagggaattgttttttgacgcccacctccggctgccgaatcgcgtagttgttcataaacagaccccgtttcttaaagaggagcgggaagggctccaagcaggtctcgagggagtcgcgtgtgtggaactcttgcaaatttttgtagacgatacgttgcgatatgtggctagtcgaccaatgccgaatggagatttcgaaatccatggctatcctatccgaaggggcaccacagtagtggtcgacgaccagaccgcattgttgtgggtacacggcacatcaaccgcgctcaacccgcggcagagctattttcagggcaaacgccgcataccggccccccttgtgatgaggcggcacgcggggacgtctgatctgatgatgttggcggacgaaatattgggactgtccaaaatgaattttaacagttttgacctgtatggccaactcccggcaaccatcgaaacgagccaaagagtcgcgaggataggcgctctgctggaccgctatacggaacggtcatacgattatcgactctttatgtagtaactcgaggttaacttgt

SEQ ID NO: 277 - DNA, 2399 bp, Artificial Sequence
  Description of Artificial Sequence: Synthetic polynucleotide
ggtgtcgtgaggatccatgcctaagaagaagaggaaggtggaggacccaaaaaagaaacgaaaggtggggtctggctctatgccacacacctccctgctgttgaactttctgcccgtctctcttagcggcgacacacgcatccatgtcggctaccggccatataacgaggatgtgctgcgggaactgagggaggagttcggcgaaagccacgtgtttaaaagggactaccaggaggacacgataagcgagataccggtcatccccggagccgagccccttagcgacaaatctactggcgtggatcttgccgaagcgcgatggctgtggaaaccacttctgaacgctgcattgcttcgcctcttcagcggaagcagagagatcacctctgattatccagtcagcgtgcttggtaaccccaagaacaacttcatcagccatgccaatctccccgactgggtgagaatcctgccccttctggaattcgagagccgaaccctgttcggtggtaaatccggtccgcagtttgggcttgtttgcaacgcccgaactaggcaccaggtcctggcaggctgcgaccatctcattgaaagaggtataagtcccattggccgctatgttcagatcgaccagccacaaagagactccagacttgcgccacgcggtctgactgttggtaaggtgagctctatcgatggggacacgttgatcctggaggatcaccgaaagggctacgagcgcgtgaaggcaagcgacgctcgccttaccggcaatcgggcggacttcgactggtgcgtgaacgcgctgttgcctggacaaggtcaagcaacgctgagcagggcgtgggacgccatgagcgccctgaatcagggacccggccgcttgcaaatgatcaatcagacagctgaatatctgaggaccgtgaaccttgaggcggttcctggggtagcatttgagatcggcgagtggctgagttctaccgatgctcagtttcctgtgaccgagaccatcgaccgccctaccctcgtgtttcatccctccggccgacccaacgacacttggaacgagagggggataaaggacaatggcccgcacgaccagaggacattcacccccaaacagttgaacatcgccgtgatttgccagggcagatttgagggacaggtagacagattcgtgggcaagctgctcgatggcatcccggactttcagttgaggaacggcaggaagccctacgacgacggtttccttagccggtttaggctggagagggccaacgtgcaaacctttcaggctaacagtgcgtcccgcgaggcttacgaagcagcgtgtgaggacgctctgaaacatgccgctgataacggctttggctgggatctggctatcgttcaaatcgaggaggatttcaaggcgctgcctgggccccaaaatccctactacgccaccaaggcaatgctcctccggaacaacgtagccgtgcagaacatcaggatcgaaacaatgagtgagcctgacaaaagcttggtctacactatgaaccaggtttctcttgcttgctacgcaaagctgggtggtagaccttggctcctcggtgcccaacagagtgtcgcgcatgagttggtgattggactgggcagtcacaccgagcaacaaagcaggtttgatcagtccgtgcgatacgtaggcatcaccaccgtattttccagcgatggaggctaccatctgagcgagcgaaccggagtagtgccctttgaagattacgccaaggagctgacagacaccctcactaggaccatagagagggtgcgaagggaagacaattggaagaacactgatagagttcgcctggtgttccatgcttttaagcagattaaggacatcgaggccgaggccatcaaacaggcagtggaatctcttgatctggagaacgttgtgttcgcattcgtccatgtggccgagcaccacccttatttgatcttcgaccaaaaccaagagggattgccccactgggaaaagaacaggagcaagcgcaaaggcgtcttgggacccagcagaggcgtgcatataaagttggcggacagcgaatcccttgtggtatttgctggtgctagcgagttgaagcaggcggcacacggtatgcctcgggcctgtctgctgaagctgcacagaaacagcaccttcagggatatgacctatctggcgagacaagccttcgatttcaccgcccacagctggagggtgatgacccctgaaccatttccgatcacaataaagtacagcgacttgatagcagagcgattggcgggtctcaaacaaatagagacctgggacgacgatgccgtgaggtttagaaatattggcaaagccccctggtttctgtagtaactcgaggttaacttgt

SEQ ID NO: 278 - DNA, 2093 bp, Artificial Sequence
  Description of Artificial Sequence: Synthetic polynucleotide
ggtgtcgtgaggatccatgccgaagaaaaagaggaaggttgaagaccccaaaaagaaacgcaaagtgggcagcggaagcatgtccggccttttcctgaacttttaccaggtagacatccccaccaaatccgtaccgatccacagcgtagagtatagccattacagttcaaaggaggcctttatcgcgttgaaagaaaacttcccctactttagcttctaccgggatgacgaccgaatactgatctggaagaaagacaaggatgccgagctccccgagaagaactcattgattgaaattgatttcaccgagaaagcgaaggtcctcagcaaaatactcgagagggccatcattgacttcatcgagccaaagggctacaagatattcaagaacaagtacagcaacagctgggaaatagtgagcatgaaggacatcctgaatggtgggatcgagggactcagcatcaatcgaatcgtgcatttttccccctgcttcttcttcaaggagaacaaactcatgctgggtttcagccttagcacaagcctcaaaaacgtgtttacctggaataaggcggacttcgaaaggtacggctttgacatcaagggccttaaaggagacgaagagcggatttttgccaacaagcaatcccttaagaggttcctggagaccaagggcgcagttgcaatgtatgaccaaattatcgcaaaggaaaacaagaacgcgaaaatgtttagcatcatcgacggcttctatcggtggctggagaggaacaagactgaaatccagcttccattcggactgaagataaattcagtgtctaaaaagtacctgccgttcgaggatgagctgatcaagagcgagatcatccctaagccccaaaggtatttctatagcaataggaagaacacccagagcctgcggtactatgacgagatggtgaagacttatcagccctactctctggagctctaccaaaacaaacagatcaacatcggaatcatctgccccagcgagtaccagggagagacggaggggttcataaagaagatcgaactgaagctcaaggaagtattccatttcaacagcctgatctttcacttcaagaccattacgaacaaggacctcgcgtcctataaggaggttttgtacgacgatgaactgctgaagtgcgacctgatttacgtcatcgtgaatgaggcccaggagaaactctcacctaataactccccttactacgtgtgcaaggccaagtttataggcaatggcatacctacgcaagacattcagattgagaccatccggcagaacttgaatgcgttcacaatgacgaacatctcacttaacagctacgccaaactgggaggcaccgcgtggaccatcgagaaggaagacaaacttaaggacgagctggtcattggcatcggctccaccctgtcagaaaacggccagttcgtgctcggtatcgcacaaatcttccataatgacgggcgctacatggcgggtgactgcagccccctttctaccttctccaactacgcggagaacctggaggatcacctgtacaagaccctgaagcccctggtggaggagatgagcaaaagcggcaccttccggctgattttccacttgtttaaaagtgcctctgaggagtacgagatacgcgcgatcaacggcctgcagaagaggctggcgaactacaatttcgaatttgcactcgttcacctggcctatggacacaacttccgactctactacaacgacggcaacggcgacattaatcagggcacatatatacaactgtcaaaacacagcgccctgctccacttcgttagcaagtcagacttgcccctgaaaatcgacctggacaagcggtctactttcaccagcctgttttacatcgccaagcaggtgtactggttcagccatctgagtcatcgcagctatatgcccagtaagaggaccgtgaccatcatgtatccgtcaatcatggcgaagatgaccgaggagcttaagaaggtggaaggatgggactacgagcgcctgaaagcagtaagcgataagctgtggttcatctagtaactcgaggttaacttgt

SEQ ID NO: 279 - DNA, 2345 bp, Artificial Sequence
  Description of Artificial Sequence: Synthetic polynucleotide
ggtgtcgtgaggatccatgcccaagaaaaagagaaaggtcgaggacccgaagaagaagcgaaaggtaggaagcggtagcatgaaaagcaacttcttccccatccagttcaacttcgacgacttccatatccagaggcttccctaccagaaggaggtgctggacaagcttcggcaacaacacaatgcgacccatagctttttccgcagagacgattttatctatattagcccaggggtagaggccgcagcgaacctgggagacgtagtacgcctctctattaccaagcaccccgaggtcgttgcttctcttgttaggcacatattctttaggacaatcaaggataaggtccccggtctgctgccaagctttcacccattcacctttcccgccaaacaggacaaatacgatctggccctgaacatgctccccgagcgcctgcagaatgttatcacctacaagaggataaccgaggtacagcttcgattcaacgagaccgaagagcaaccccagttcgtcgccgtagttaaccacaggtaccagtggactatcgaccgaacttgcgagcaattggtaaacgagggtctggacatccttggcctggaggtgaactctagtacgagccctgattattcagacggagttgtggcaccagagctgacactgttgggcagggtgatggccgtgaacggggatcacgccacagtagggaccaaccagggtccgacagagtatgccctgttcgaattgaccttgttcaagtccaaggagaacatagtgaactaccttggatctttggtgggcgagggtaaagccgaacaaatagtcaaccatatcaaacaagatgaaagcagaaggctgcaaccggacgttgtgatgagggagatcgaggaaatgggagtgtggctgtctaggctggcctacagaaactttgactccttttgcttcaccatcggaacgaacaacgctgtcagcggccaagcaggtatcagactggaggagccaaagctgatatttgacgtctcaggtacgaacatacacgctacccccacaaccgggctcaacaccttcggcccctatagtagaagcacgagtttcgacgttaactctccgaagattctggttgtgtttcaccagcggaacgcaggccacttcgcagagtttctcgcacagctgaagggcggcatcgctcagcacgcatactttgctaacgggatggtcaggaagtatggtctcacggcaatggagtaccggattgccgagatcactgactacaccgtgccccaatatcttaccgccatcaataagctgcttagggcggagaacggaagctttgacatcgccatcgtggagacctgtgaggatttccggaggctgcctcccatggataatccgtattttcaggttaagagtttgttgtacagccatggaatcagcacccaattcatcagagcggaaaccgctcagaaaccgatttattcaatagatagcatcgcgctccaaatgtacgccaaattgggcggaacaccatggacggtgccaatagggccgagcgtagatcacgaattggtgataggcatcggtagctccatattgcgcagcaaccagtatgcaggtgcaacccaagctcgaatagtggggatttctaccttcttcagcgccgacgggaagtacataagcaatagaaagacccaggacgtgccttacgatcagtacttcgatgagctcttgcataaccttaaagtctccatcgacgagatttccaataactacagctggagctcaggcgaccgcatcaggatcatattccacatcttcaagcccataaaacacatcgaggcagacgtcgtcgcaagcctgatggaacagtaccaggagttcgatataaagttcgcttttgtgacctttagcgagttccacccgtatgtgctgtttaatgaaaatgaaaggggggaatttgatgcgtataggaaggtttacaagggcacccatgtaccgtggcgcggttacaatgttctgctggatcctcggtcatgcctggtccagatgctgggaccccatgagatgaagaccagccggcacggcgcttctaggcccgtccttgtgagaatccaccgcagttctacgtttgtagacctcgcgtacgtcgtgcaacaggcctttaagtttactaggctctcattccgcacgttctaccctgtgcatagccctgtgacgctgctctacagtaatatgttggcccgacagctcaaggacctgaggggcattccgggttggaactacgatgtagctagcaggcagttgaggcacaagaaatggttcctgtagtaactcgaggttaacttgt

SEQ ID NO: 280 - DNA, 2645 bp, Artificial Sequence
  Description of Artificial Sequence: Synthetic polynucleotide
ggtgtcgtgaggatccatgcctaagaaaaaaaggaaagtggaggacccaaagaagaagcggaaggtgggcagcggtagcatgcaaggcactatatccataaacgaggtgaggatccagcttaatactattaagaatctttcagtgttcaagtgcagcctcagcggaattagcacccgccataagaaccagatcgagttcatccttcgcagcgagcaaaaccgagttagcatctttgagggtgaagtgatctttgcgcttcccgtcgaacagcagaacctcgaaagagataagcaggctctgttcagcttcctggtcaaacaacaaagggatctcaatctgaaacagctgagcctggtgcccctgagggaggtgcccgagcgcgttatcgagcgactgactttcgcaatggttagctatcaggccatgaagcagggcatcttctctatctatggtcatacattttttcgccccacccttatgacggataggcttgcgcacaaggcggtggaagtcacgacgtgcatcgaggatggcttcctcaagttttatctggacccgacgtacattgcactgacatgcataacggacacagcacgcgaaaatagggagaacctggaactggtcgggctctgctctttccgcaacaaaaacctttgtagccttgtcaggccggacggctcatgcaactgcctcatacctggtaagttggggtattacgtccaggagatggggattaaggacgttgaggatgatagcaaggactttctggccaaacggttcaatagctgtccccggtttagtgagcacacgcgctttatacaagtgaaggcgagtaaaagaggcacgaagtactccctgttcccttcttacgtagtttttagcaggttgtcccgaatggacctgtccgctaagccagatgtgcggtccagttatcggaaggccacattgatggactctcacgaaaggcttaacttgaccaacgactggataagacaaattttcatgatcgggcagaagggccttcaaaattggggtgttataaaggtcaaccagaccgagattcccgttgaaattgtactcacaattgcccacgccatcgcgcccaagacttctcaaggcatctataaggctatattcctcccggaccagcaaattacgaatgacagcaataacccaacgcctcaaacgctgagcgggggttggctcttcacgaataggggtgcgttcgacaggagggatcctaataggccttttaaagtaatcagcccctacatcatcgtgcccaacaatgagcaaagcatcagctcttgccgccagctgatcaactacttcagcaacggcaggtacaaggcccggtgcaagggtgacagagactttattggtatttcattgcccgaaaacaagggcaagtacaacacatcatttgtcaatgctttcgaagaggaggacggcctgtatttcgttgaagagacgatacagggctaccagaaggcgctgcaagacattgttagagactggaatatcacgtccaagcgggacatcaataaacacgctatagtgatcataccgggcgagaacgatattgacgacaatcctttctattatcaactgaaaaaggcgttcgtagaggaagggattcccagcaccttcatcacgtacgagactatgaacaaaatcaacgaccccgacatcgcgttcgggccaatcatggacagcctgtggttgaacatttacagcaaaatggggggcaaaccgtggcgcctcgctaatagcctcggcaacgtgcactgctttatcggtattgggtttggaattaaccccgagaccaccggaaaccacatattcgcagggatcgcccacatcttcgacaactacgggagttggatagacgtagcgagtgattccgccaacctctcccaaaacgatctgaactcattcgagggcacggaaaagtacacacaggggagtgctagctttaagatcagtcagagcgtgtcccagtccattgtgtataacgcattgaagctgtaccaacagaagcaaactaagacccacgaaaacgccacaaacatcgtcctgcacaaactgggccagatctacgagtgtgaggtcatcgggttcctcgaaggaattcgccaagtgctcgggagtctgggcgactgcaagctgggattgctgcaaattgagcaggagcaccacctgcgcctctatggcgcagcagcccaaaccggcaaggagaacaacacgatctttcgcggttcagcacttcaactcaacccggagaagctggttatcgcgtccactggccgctcttaccggcagacgagctccgggctgtttatgaattatccgggcatcggcaccccccagccgctcctgttgacttctatcgtaccgaatcagcagatcctgcagaagtacggctgtaacgcaaaccaattctactcaagcgaggacctggcgaaacatgcaatggccctgacgcaacttcactgggggtcactgaaggataatgtaagattgccgattaccacgctttacgcgcaaaaggtcgccgacttgattagcaagaccaacatgcggatcaatccaggcttgggctacttccgaccctggtttctttagtaactcgaggttaacttgt

SEQ ID NO: 281 - DNA, 2189 bp, Artificial Sequence
  Description of Artificial Sequence: Synthetic polynucleotide
ggtgtcgtgaggatccatgcccaaaaagaaacggaaggtggaggaccctaagaaaaaacgaaaggtcggaagtggcagcgttccagtgtaccttaatcggttcctgctggaccacctcacatcacccttgtccttgccggcgtttcgggtcgaactggaccctcccccttccaaagatgaagtgcacccgctcctggctctcgtcggtcgggaagcgggagggctcgtgaggttccagaacaggctgatcggctgggaggctccacgggccctcgaaggtcaggttaggcgaggcaagcagtcatatagactggtgccccttggccggcaggcactcaatcttagaaaacccgaagaaaggcaggcgctcgagaatttgtataggatccgactggaaaacatcttgaaagccctcgccaaacgacatagggctagagtcgaacgcaggggcaacggcctttttctgtggaggccagagaatccccgagaggagaaggaggggtggcacctttaccggggaagcctgtaccgcatacatctctatcctgacggcgaagtgatacttgaagtcgacgtgcagcatcgatttcaacccactctccatctcgaggagtggctgcaacgaggctatccactccctaggcgcgtgactaacgcctacgaggacgagaaagaatgggcactcctgggcatcgaagaggggaaggatccccgctcttttctcttggatgggggcgagtcattgcttgactaccatcgcaagaagggacgattggcagaggggcaggaccccggtcgagtggtctgggttgctagaggtaaagaacgcgagcggatcccacatctgagcgtcttgttgaagccagtcatcaccatggagctgctggcggaagtcgctgaggtcacgcaggaggccttgcctgcgcttcagctcgaacccgaggaacggctgaaggacattaggcgcttcgctgaacctgtactgcaagcgttcggcaaacgcgaaactgcaaaaccccttgaaggcagagcccagcgattgccgcgacccagtttgttggcacggggaaaaaagcgagtgggcaaagtagcggacgtactcgaaaagggagcattgtcaccgggcgagacacggttggccctgctcgcatgggagggagacgggaaggccaaaggcggtctcgcgtacttggaggagaggcttcagggcgtcgggtctgcatccggcatcaaacttgaacttaaacggcgatttctgccccgaggcgataacctcgaaatggcacaggtgtttgaggagctctcccaggaaggagtaggtgccggtctgcttctgactccgcgcctcacagaaggggaaagacgcgaactgaaaaatactgcggcgagccatgggctcgctctccaactccttaacccgtttgaccctggcgacatctacagggtgaataacgctctgcttggatttctcgcgaaggccgggtggctgttcctgagactggagggaacttatccggccgacctggtggtggcctatgacgcaggcggggagagtctccgattcggcggagcctgcttcgcccacctgactgatggcacgcatctggggttcagtctgccagccgctcagggtggtgaacggatggccgaggaggtcgcgtgggagttgctgcgacccctgctgttgagataccggaaagcgaagggccagacaccagggaggatctttctgctccgcgacggtaagattcaaaaggaagagttccgaaaagtggaagaggaactgagaaagcgcaatattccctacgcgctgtttagcgtccggaagacgggggctccccgactgttcagcaaaaatgggccgctcggtgacggtctttttttgcgactgccagaggaggagggcgggtttctgttgcttagcgccgagggtgggaagggcaccccacggccggttaagtatgtgttggaggcgggagaagtggacctcaacctggaggaagctgccaggcaattgtatcacctgagtcgcatctacccgggctccggttaccgattccccaggctgcccgcaccgttgcatatggttgataggatggtgagggaggttgcacggctcggcggcagccataacttgagactcaaagaagaacaactgtttttcctgtagtaactcgaggttaacttgt

SEQ ID NO: 282 - DNA, 2336 bp, Artificial Sequence
  Description of Artificial Sequence: Synthetic polynucleotide
ggtgtcgtgaggatccatgccgaagaaaaagcgaaaggtggaagacccaaagaagaaacgcaaggtgggctccggcagcatgaataacctgacactggaggcctttcggggcattggcaccatcaagccactgttgttctatcggtacaagctgatcggcaaagggaaaatagagaatacctataagacgatacgcaacgcacagaatcggatgtctttcaacaataagtttaaggccaccttcagtaaggatgaaatcatatacaccctggagaagttcgagattatcccgacgctggatgatgtgacgatcatcttcgacggggaagaagtgcttcctataaaggacaacaacaagatttacagcgaggtaatagaattttacattaacaacaatctccggaacgttaagttcaactataagtacccgaagtacagggctgccaatacaagggagatcacgggcaacgtgatcctcgacaaagatatgaacgaaaagtacaagaagagcaacaaaggcttcgaactcaaacggaagttcataatcagccccaaggtcgacgatgagggtaaggtcacattgttcctggacctgaacgcgtcatttgactacgacaagaacatctaccagatgataaaggccggaatagatgtggtaggagaggaggtcatcaacatctggagcaataagaagcagcgcggtaagatcaaggaaatcagcgacattaagataaacgaaccctgcaacttcggccagagcctgatagattactatataagcagcaatcaggcgtcacgggtgaatggatttacggaggaagagaagaacacaaacgtcatcatcgtggaaagcggcaaaagccgcctgtcatacataccgcacgcgctcaagcctatcataacgcgagagtacatcgccaagaacgacgaagtctttagcaaggagatagaagggctcatcaaaatcaatatgaattacaggtacgagattctcaagaggttcgtctccgacatcggcactattaaagaactgaacaacctgcgcttcgagaaaatctatatggacaatatagaaagcctgggttacgagcagggtcaactcaaggaccccgtgctcatcggcggcaagggtatacttaaagacaaaatacatgtcttcaagagcggcttctacaaatcccccaatgacgaaattaagtttggcgtgatatacccgagaggctacataaaagatacccagagcgttatccgagccatctacgacttttgcaccgagggcaagtaccagggaaaggataacatattcatcaataacaagctcatgaacatcaagttctccaataaggagtgcgtctttgaagagtacgagctcaatgacataaccgagtataagcgggctgcaaataagctcaaaaagaatgagaacataaagttcgtgatcgcaatcatccccactatcaatgaaagtgacattgagaacccctacaaccccttcaaaagggtctgtgccgagatcaacctccccagccaaatgatcagtctcaaaactgcaaagcggttcagcaccagcaggggccaatctgagttgtatttcctgcataacatcagcctcggcattttgggcaaaataggcggcgtaccctgggtaattaaggacatgccaggcgaggtcgattgttttgtgggcctggacgtgggcacaaaagagaaaggaatccactaccccgcatgcagcgtgctgttcgacaagtatggcaaactcattaactactacaagccgacgatcccgcagagtggagagatcattaaaacagacgtgctgcaggagatctttgacaaggttctgctgagctacgaggaggagaacggccagtatccccgcaacatcgtgatacacagggacggcttcagccgggaggacctggagtggtataagaactacttcctgaaaaaaaacatcgaattcagcatagtagaggtccgcaagaactttgccacgcgacttgtaaacaacttcaacgatgaagtgtccaacccaagcaaaggttcattcattttgagggacaacgaagcgattgtcgtcacgacggatattaacgacaacatgggagcgcccaaaccgatcaaagttgagaaaacgtatggcgatattgacatgctcacaattatcaaccaaatttacgcactgacacagattcacgtggggtccgcgaaatcccttagactgcctataaccacgggctacgccgataagatctgcaaggctatcgattacatcccgagcggccaagtcgataacaggctgttctttctgtagtaactcgaggttaacttgt

SEQ ID NO: 283 - DNA, 2342 bp, Artificial Sequence
  Description of Artificial Sequence: Synthetic polynucleotide
ggtgtcgtgaggatccatgcctaaaaagaaaaggaaggtagaggaccccaagaaaaagcgcaaagtagggagcggtagcatgaactataccgctgctaacacagcgaacttcccgatatttctgagcgaaataagctttctcacaaccaataacatttgcttgaactgtttcaagcttaactaccaggtaacgaggaagatcggtaaccgattttcatggcagttcagcaggaaattccccgacgttgtagtgatattcgaagacaactgcttctgggtcctggcaaaggacgagaagttcttcccctcaccacaacagtggaaggaagcacttagcgatatccaggaggttcttagagaggacatcggggaccactactacagcatctattggcttaaagactttcaaataaaggccctggtgaccgcccaactggcggtgaggatactcaagattttcggcaaatttagctacccaatcgtctttcccaaggatagccagatatcagaaaatcaagtgcaggtcaggcgcgaagttgacttttgggccgagatcatcaatgacaccaaccccgcaatctgtctgaccgtggatagtagcattgtgtacagtggcgaccttgaacagttttacgaaaaccacccctacaggcaagacgccgctaagctgctggtgggactgaaggtgaagaccatcgaaaccaatggcaccgcgaagatcatacggatcgccggtaccataggcgagcgcagagaagacttgctgaagaaggccacaggctcaatgtcacgacggaaactggaggaagcccatctcgaacaacccgtcgtcgcagtccagttcggaaagaacccccaggagtacatatacccgcttgcggcccttaaacctagcgtgaccgacgaagatgagagcctcttccaggtcaaccacggagacttgttgaaggagaccaagatcctgtatgcggagaggcaggagcttctgaagctgtacaagcaggaggcccagaaaaccctgaacaactttgggttccagttgagggagaggtccatcaattctcaggaatatcctgaggtgttttggactcccagcatcagcctggagcaaaccccaatcttgtttggcaagggggagcgaggtgaaaaaagagagattttgaagggcctgagcaaaggcggagtgtacaaaaggcacagggaatacgtggacacagctcgcaaaattcgcctggccatacttaagcccgctaacctccgcgtgggcgactttcgggagcaacttgagaagcgattgaagctttataagtttgagacaattctgccaccggagaaccaaattaacttcagtgtcgaaggcgaaggttccgaaaagagggcccgattggaagaagcggtcgacagactcataaggggggagatccccgtagacattgcactggtgttcctcccgcagagcgataggaatgcagacaacaccgaggagggaagcctttacagttggatcaagagaaaattcctcgataggggcgtgattacacagatgatttatgagaaaacgcttaacaataagtcacagtacaacaacatcctgaaccaggtggtgccggggattcttgcgaagctgggaaacctgccatacgttcttgcagagccgcttgagatagccgactacttcataggcctggatgtggggcggatgccaaagaagaatcttccggggagcctcaacgtgtgcgcgtctgtcaggctctatggcaagcaaggcgagttcgtgcgctgccgcgtcgaggacagcttgaccgagggcgaagagattccccagcggatcctggaaaattgcctgccccaagcagaacttaaaaaccaaactgtccttatctacagagatggtaaattccagggaaaggaggtggataaccttttggctagggctcgcgcaatcaatgccaagttcatactggttgagtgctacaagaccggtatcccccgactgtataacttcgagcaaaaacagatcaacgcaccctccaaggggctggcactcgcgttgagcaaccgagaggtgatcttgattacgagccaagtgagcgagaagataggcgttcctcggccacttagactcaaagtgaatgagctgggtgaacaggtgaacctgaagcagctggtcgataccactcttaaactcacgctgctccactatgggtctctgaaagacccacggctgcctattcccctgtacggtgccgacatcatagcctatcggcggctgcaaggaatctacccatcccttctcgaggatgattgtcagttctggctgtagtaactcgaggttaacttgt

SEQ ID NO: 284 - DNA, 2561 bp, Artificial Sequence
  Description of Artificial Sequence: Synthetic polynucleotide
ggtgtcgtgaggatccatgcccaaaaagaagaggaaggtagaagatccaaagaaaaagcggaaggtcgggagcgggtccatcaccagctacccttacgctaggaacaaggccgacatgattcgcaaggttaattggaatctgatcgtgttcgacgaagcccacaggatgaggaatgtctataagaagtccaataagatcgcccgaaccctgcgcgaggccactgccggctatcccaagatcctgctcactgcaacccccctccaaaactccctcatggagctctacggattgatatcttttattgacccccacatcttcggggatgagacaactttccgcagacagtttagtcgcggcaccaaggaaatgagcgagatggactttatcgacctgaaacaacgaattaaacccgtgtgtcaccgcaccctgaggcgccaagtcacagagtacgttaactacactcagcgcattccgatcacccaggagttcatgcccaccaacgaagaatgggagctgtacgagaaggtcagcgcctatttgcaacgagaacatctcttcgcgctccccgcgtcacaacgagcacttatgaccttggtagtgcgcaaactgctcgccagctcttcatttgctattagcgataccctgctgagcctcatcaagaggttggaacaactgctggaacagctggactccggcaagacggagattaccgtagaacacagcgatgtctacgcggacgtggacgagtttgatgatacagtggaggagtgggaggaggacgaccagccttcttacatagataaactgagcccagacgagatgaaacggttgattcaggaggaaaaggaagaactggagcagtactacagccttgcaaaaagcattaaagagaactcaaaggctgaggccctcctcatagcgcttgaaaaagggtttgaaaagctcaggatgctgggggctaatgagaaggccgtgatcttcacagaatcccgacgcacacagatgtatctgagagaattcctggagagaaacggctacgccgggaagatagtgctgttcaacggtgaaaaccaagacgaacaagcgaagcagatctatgagcagtggttggagaagcaccgacacgacgacaagattacgggctctaagacggcggacatgcgagccgcgctcgtggagtactttaaggagcaggctagtataatgatagcgaccgagagcgccagcgaaggcatcaatctgcaattttgcagcttggttgtgaactatgacttgccatggaatccgcaaaggatagagcaacggatcgggaggtgtcatcgctatggtcaaaagcacgacgtggtggtaataaactttctcaattgtaaaaacgaagcggacaagaaagtagatgagatattgtccgagaagtttcggctgtttgagggcgtatttggcagcagtgatgaagtcctggggtccctcgaaagcggcgtggatttcgagaagagaatccaacaaatctaccagacctgccgaaccgcggaagaaattgagcaagcgttcaagaacctgcaagctgagctcgacgagcaaattcaactgaagatgaaggagacccgaatgcatcttttggaaaacttcgatgacgaggtgagggaaaagttgcgagaccattatcaccaaacctccctgcatctgaataggatggaaaggtatttgtggaacctcagcaagtacgagggggcacgcgaagccatctttgacgacgagacgctgtccttcgtgaaggactacgagacctatcagatgatcagccaggcgaagaaacaaaacagtccaaacgtgcatcactttcgattctcccacccgcttgcgcagaagtggatcgaacaggccaagagcagggaattgttgccaaaggagataacgttcaggtacagcgactacaagggcaaagtctccatcttggaaagactcatcggcaaggagggttggttgagtctggacctgcttcacgtccagagccttgagagcgaacaacacctcatctttagcgccatcgacaccgagggcggtcaactggaccaggagatgtgcgagaaaatgttcgagctgcccgctgtggagggcgaggaagtagagatatccgactccatccgaaacacattgagacgaatctcagagggccagcaagaggcaatactgaatgagattatggaacgggcgtccgcctacctcgactcagaactcgagaaactggaaaaatggtcacaggacctcaagaataagctggagaaagacattgatgaaatgacggtggagatcgagcatcttaaacgggaagctaaattgacacgcaacctggcagaaaaactcgaaaaaaacaaacagatcaaggagcttgagaagaagcgcaacgaaatgcgccggaatctctatgaccaacaggacgaaatcgatgaacaaaaggaccgcctcttcgaggaggtagagaaaaaacttgaacaacggactgcgacggagcacctcttcactatcaaatggcggatcgtgtagtaactcgaggttaacttgt

SEQ ID NO: 285 - DNA, 2231 bp, Artificial Sequence
  Description of Artificial Sequence: Synthetic polynucleotide
ggtgtcgtgaggatccatgcccaagaaaaagcgaaaagtagaggatccaaagaagaaacggaaggtcggcagcggaagtgtgaaccattactatttttccgaatgcaaggcggacgagaaagccagcgacatagccatccacctttacaccgtgcccctgtccaacccccatgagaaatacagctatgcgcacagcatcgcctatgaattgagaaaactcaactcatacataaccgtggccgcgcacggtcagtacatcgcgtctttcgaggagatatgccactggggcgaccacaggtacatacagcacgaacatagaccaatccagtgcagcctcccgatggagaggaccatactggaaagactcctcaagaaagagctcgagaataggtgcaaaagcagctataagatggacaacgaccttttccggttggctaacgagcaaagcatgcacgtgggcgagatcagcatacacccagcgatctacatctcattcagcgtggaggaaaatggtgacatatttgttggcttcgactaccagcaccggttcgagtaccgcaaaacactccaagacgtcatcaacaacgatccctccctgcttaaggaaggcatggaagtggtggaccccttcaatagaagggcctactattacacttttgtgggcatggccgattataccgccggacagaaaagccccttcctgcagcagtctgtgatcgactattatctcgaaaagaatgagctgtggaagctcaagggtgtgcacgaaaaaacccccgtggtgcacgtcaagagccgagacggtcacttgctcccgtatctgccgcacctgctcaaattgacatgttcatacgaacagctcttgcccagcatgaccaaggaagtcaatcgcctgattaagctgagccccaacgagaagatgagtaagttgtatacggagatgtttcgattgctccggcagcaacaggtgctgaccttcaagaaggaaaacgtgcgagccgtcaacctcggctacgatgtgaatgaacttgacagcccgatcatggagttcggacaaggctacaagacaaacgagatctatcgaggcctgaagcagagcggagtatacgagcccagctcagtggccgtgagcttttttgttgaccccgagcttaactacgacccccagaagcggaaagaagtaggttgcttcgtcaaaaaactggagagcatgagcgaggccctgggagtaaaactgaacataagcgaccagccccgacaactttatggccagctccccaaggactttttcaagcaggacaacctctcatatcatttgaaatctatcaccgaccagttcaggggaacggtggtggttgttatcggcactgaagagaacatcgaccgggcatacgttacaatcaaaaaggaattcggcggcaaggaggatctgatgacccagtttgtcggcttcacctcctccctcgtcacggagaacaacatttttcactactacaacatcctgctcggcatctatgcgaaagctggtgttcagccctggatactcgccagcccaatgcactcagactgtttcattggactcgacgtaagccacgagcacggtaagcacgcatcagggataatacaagtgattggacgggacggcaagattatcaaacaaaagagcgttgcgacagcagaggccggagagactattgccaatagcacgatggaagaaatcgtcaacgaaagcatttattcctacgagcagatctacggggccaaaccgcgccacataacattccatagagacgggatctgtcgcgaggacctcgattttctgcaagcgtatttgcggagtttccaaatcccattcgacttcgtagaaatcataaagaagccgcgacgcagaatggcgatatactctaataagaagtgggtcacgaaacagggaatatactacagtaagggcaacaccgcttatctgtgtgccacggaccccagagaatccgtgggtatggcgcaacttgtcaagatcgtacagaagactaacggattgagcgttcacgagatagtgagcgacgtgtataagctgtccttcatgcacatacacagtatgctcaagaccaggttgcctatcacgatacactatagcgacctcagctcaacgttccacaaccggggcttgatccatccccggtcccaacatgagagagcactcccgttcgtgtagtaactcgaggttaacttgt

SEQ ID NO: 286 - DNA, 1811 bp, Artificial Sequence
  Description of Artificial Sequence: Synthetic polynucleotide
ggtgtcgtgaggatccatgcccaagaagaagagaaaagtggaagatcccaaaaagaagcgaaaggtgggtagtgggagcatgaatttccagctgtgcgaccaacgcaaagccattatcgccgaaccaggccatctgttggtcctcggtgggccaggaagcgggaaaactaccgtcgccctcttcaaggccaagcagagatttagcactctgaaacctagccaagaaatcctgttcctgtcattcagtagagctgccatcaggcaggtcctgctgcggtgcaaggagattctgaagcccgcagagagacgcgctgtcgccgttcaaacctatcatagcttctgcatggacatgctgagggcgcacggtagactgctcctgggccaccccgtgcgattcatgtatcccggcgacgagaggcttcaaaaggccgcattcgagggggactgggaggcggaaagacaaaggcaagccaaagagatgggcatcttttgcttcgaccttttcgcgcaaggcgcagctgagttgctcgagaggtgtgccgcacttaggaagcttataggggacagcttccccatgataatagtggacgagttccaagacaccgacgacaaccaatggcggatcgtggcgcaacttgccaaggtagcggacatcttctgccttgccgaccccgaccagaggatctttgactaccgagacgacatcgacccccttcggatcgagggtttgcggaccactcttgcccccagggagttcgatcttggcggtgagaatcaccgctccccgaacgcagggatattgaacttcgccaacgctgtgctgcataaccagagccccctgcccgataccagcgacatcatgcaactgcggtactggcctagagcgttcgcgagcaccgtgcatgcctgcgtagtgtttaccttcagcgaactcaggaaactgggcgtggagaaccccagcgtggcagtgctgagccgatccaacgggcttatcagcgatgtgagcgccatactggctgagaagcacgcgtacaacgggagggaactgccaatcgtggaacacgacgtggtttgggacgcggagctgtctgcggcagcagccgtcgtcgttgcgtccaccctggagtggccaacagccgctgcagaggttgctgttgccaggacacttgcgctcatagcagcctattacaagctgaagaacgccgaggaacccaccaagagcgcggctgaggctgcccaaaagtacgaggcggctgcaagcaaggtggccagtgaggagaccccaaggatcaaagccgcgaaagaattgctggccgctcaccaaagtggcatccagatggtgggcgacccggtggccgattggaagtctgcgaggagggtattgcaagagataagcgccctgggtgagttgtacagggaggtccggctcgtgaggttgttccgggcaaccgacgccttggcttccggcctgagcaataggtggttggctactggaagctacgagggcgtgtccgacctggtgaagggcatccttgagcaggagaaactgattgccgtggaaagggacccaagaggctgtatactgatgaacatccataaaagcaaaggtaaggaattcgacggcgtggtactcattgagggggcatttaagtcccatttcttcgatgagcggaaggaagtcagcccctatgagaggtccagacggctcctgagagtcggtctgacccgcgctaggcatagggtgacaatccttagacctcagggagcgaggccccttgtggatcccatctagtaactcgaggttaacttgt

SEQ ID NO: 287 - DNA, 2384 bp, Artificial Sequence
  Description of Artificial Sequence: Synthetic polynucleotide
ggtgtcgtgaggatccatgcccaaaaagaagaggaaagttgaggatcccaagaaaaaacgaaaagtgggtagcggtagcgttccaggcggtaggggaccgctgctcgtgcttaacttccttcccgctcgcttcgacggccgagttgatgcgggcaccctccccttcgagacccctgataaattgagggccattagggaggaactgagaacttcccatgtagttgtaacgcgaggaaaagaggtcgtatgcgtgcccttcgttagtggcgcgaaattgatcggcaaacgaaccactatcaccgcagcgggacccgacctcgtcgtacaaacgagtcttctcgaatccagcctgaggcggaccttgaccgaaaaatggaagtacgaattgcgcagggaaaacccgctcacctttgtgtcaaggacgccaggaagggacctgctggagaaggcccttggtcgggagttgccgggactccatgtgttccccgcttacagcctggacgtgcgcagatacggtcctggggggttcagcggggttgttgtaggattgaagacccgctatgagatcgacctgcctgtcggagtgctgctcaggaggggcgttcaagtaaacggcctttatgtcctggctgaaagccccctcgcgcctacgtggcccttccaagatccccacaccagaaggcggctcgtgggacaagttgtcgcggtggatggcgacaaattgcgagtgaggtgtagggacggggagctggaacttgatgccgccgaagcatggattgagcccaacactgccaacttctacgccgtcctgcggaaggcgtgcggacgctcttacgaacgagactttcacgccctggaagcccaagtcgtgtccctgactaacgcccagcagcgaatcgccgataccaacaggatcgccgccaacctgataggccttggtaaattcgacatcagtaacggcttgactgccgagctggggaaaccactcagactgacttccactcaacatccacacgttcggactctggccgagcccacatttgtgtttgaccagagcggagacaaaaccgcgccttttcccgagaccgggctgaccaagtggggcccattggacgctgagagctttacacccaaggcaccacacatcgccgtggtggttccgcggcagtttcagggtcgcgtcgaaacgctggttgagcggttcaggaacggcgtgaggggcagcaacgcctatgccgagggctttgtccgaaagtttaggctcaccgactgtaccttcagcttcaccgtttttgacggtgacgctactgacgcagccgcatataggcaagcgtgccttaccgccctgagtaatgacgagcaaattaacctcgccttcgtcttcacatcagccgtgcaggagcatcaaacgggggacgacagtccctatcttgtcagcaaatccaccttcatgagccagggtatccccgtgcaagagtatcaagtggagaacatcatcggggattcaaacttggcttatcccctgtccacgatggcgctggcgtgctacgccaaactgggtggcaccccttacgccataagcgatcgaggacgacctatggcacgagaactgatcttcggcatcgggtctgcccaggtaagcgacggaaggatgggcgaaacagagcgatttgtgggcattaccaccgtgttcaattacgacggtaggtacttggttagcaacgttagccgcgagacaccctacgaaaggtacccgcaagccctgcttgacgcattgcggacttgcattgccgacgtgaaggttaggcagggatggaggtccgacgactttgtgcggcttgtcttccatatcttcaaacctctgaaggacaaggaagcacgcgccgtaaaagagctggtgacggagctgacgtctgaatatgccagcgtggagttcgcttttgtgacagtggtggacgatcacccgtggctggtgctcgatgaaaacagcgatggggttaaggttgggcgagggactaagggcaagcacgtagctcggaggggttttgccctgccgatttccaaaagggagcttcttgtgacggttaaaggtccccgggaaatgaaatccgataagcaaggggctcccaagcccctcttgctcaagctccatcgcgaaagcacctttacagacatcgactacctggcttcccaggtctttcaattcaccgccatgagctggcgcaggccataccctaccagcaaacccgtgactataagctacagtgacctgattgcgggacttctcggaaagctgcgacacgtgacgaactggaatagcgacatgatctacatgaagttgcgcttcagcagatggttcctgtagtaactcgaggttaacttgt

SEQ ID NO: 288 - DNA, 2153 bp, Artificial Sequence
  Description of Artificial Sequence: Synthetic polynucleotide
ggtgtcgtgaggatccatgccgaagaagaagcgaaaggtcgaggacccgaaaaagaaaaggaaagtggggagcggcagcatgcagcaggagatccagcttaacatcatccccttcaccgcccctgtggaagaggcagagttcgctttttacaccgccaagcaagacggctactgccccatccataaggatgacctgaacggggccatcgaaggcctcgtggatgaatcagacctgcactacggcaactggctgtacactgacttcgctcccgccaaagagaacgccatcataattagcgtcaatctcaatgactgtaagtacttcgcccagcactactacaggcaccttatcaggacccacttcaagggagtggccgacatcatgaggaagaatttcaccaacgaaatcgaggtctggttccacaataccaaagccagctctaccaagtttaaggtctataaccagtttaccctcaaggtacagcacaacagggtgacggacggaccggaacttgtcgtgtccttcgacgggacgacgaaggtgctgaacaagtctatcgccgagatacacaacttcaaaacggagctttacaactggataaactgcaacggcgagcttaatcgctggaaatacctgaccgacgatcagaagctgaatcacgaaaagaactacccggtagtgtcaaacacacttaaaccgcatttcgacattgcctttgacgttcccgattttaagaaccggtatcccaaatacttcactcttctgaatgacttctacaacaactatctgaatacagacgcctttactgcgatcttgccgctttccgctgacggattcttcaagccaaatggcctgtcagtgcagaggatcaacggcactagcaatgagctgcaattcggcaatggcgtcggcgtggagcccaaaagggatctcaagcgcctgaagccgtataaacccgtgcccaaacccagcaacgtaaagtttttcttcatctatcacaagccagatagggagcatgcggtcaaaaacatctggcagtatttcaaagacggatacaacggccaataccccttccccaagatggaggaatacatatctcagcccttcgagcttgaggagaatggatctatctcattcgacaatatcgacgacgcggtaagcgttgtccaaaaagccatcaagaacaaggatcggctgcccgacactaaatactttgcggtatacatctcccccgtaccaaaatgggagaaggaccctaaacggaatagtatctaccatcggatgaaagagatactcctgtacgaggggatcaccagccaggtgatctggaaggagaacattagcaaaccggctttcaacctcttcttgcctaacatcgaaaccgccatactggccaagctgggaggcgtcccctggaggctcaagagggacaccacgaacgagttgatcgttggcgtgggtgctttctactcaatcacgcggaagtccaagtacgtgggctctgcattttgcttcaataacgagggcatctttaaggggttcgactgtttcggtgccaatgacaccgacagcatcgcgggctctatcagggaggccgtgggaaagttcatcgcgtctaattacaaggccacaaggctgatcattcacttctataaggacctgtcaaagaaggagctcaaaccaatcatcgatacacttcacgccctgggcttgcccatcccagtgatagtcgtgaccatcaataaaaccgagagcaaggaactcctggcatttgataccagctcacaaaagctcatgccctactctggcaccatcgtgaaggtgggagccaaggagtacctgctgttcaacaacacgcgatacgaggaagcatccgccccaacggatcgcgagcaccacttcccggtgaaaatcagctttttctcagacaaggcggagctgttggacgatcccgcactgatcaaccaactgatcgaccaggtgtaccagttcagccgcatgtattggaaaagcgtgagccaacagaacttgcccgtaaccattaagtatcccgagatggtggcggagattttcccatactttacccacgataaattgcccgatcatggaaaggagagcctgtggttcctgtagtaactcgaggttaacttgt

SEQ ID NO: 289 - DNA, 2021 bp, Artificial Sequence
  Description of Artificial Sequence: Synthetic polynucleotide
ggtgtcgtgaggatccatgcctaagaaaaagaggaaagtggaggatccgaagaagaaacgaaaggtcggcagcggcagcatgtatcttaacctctacgaaatcaagatcccctacagggttaaacgattgtactacttcaataaggagaacgaccccaaagagttcgcccggaatctgagccgagtgaacaacatacggttcaacgacagtaaggacttggtgtggctcgaaatccccgacatcgacttcaagattacaccccagcaggcggaaaagtacaaaatagaaaagaatgagataattggggagaaggaagacagcgatctgttcgtcaaaaccatttacaggtacatcaaaaaaaagttcatcgacaataacttctactataaacggggaaataactacatttcaatcaatgataagttcccgctcgattctaatacaaacgttaatgcgcacttgacatataagattaaactgtacaagataaacgaacggtattacattagcgtgcttccaaaattcaccttcctcagtgacaagccagcccttgagagccccatcaagagcacctacctgttcaacattaaaagcggcaagacgtttccctatattagcgggctcaacggagtcctgaaaattgacctgggcgagaacggcataaaggaggtcctttttccggagaactactatttcaactttacctccaaggaggccgagaagtttgggttttctaaggaaatccataacatctacaaggaaaaaatcttcagcggctacaagaaaatcaaacagagcttgtatttcctcgaagacatcatcaatataaacaattacaaccttaccatggacaaaaagatctatgtgaacatagaatacgagttcaaaaagggcatcagcagaaacataaaagacgtgttcaaatacagcttttacaaaaatgaccagaagatcaaaattgcgttcttttttagcagcaagaagcaaatctatgagattcaacgcagcttgaagatgctgttccagaacaagaatagcatattctaccagaccatctacgagatggggttcagcaaggtgatttttctccgcgagccgaagactaacagcagcgcatttatgtataaccccgagaccttcgagattagcaacaaagatttctttgaaaacctggaggggaacattatggcaatcattatactcgacaagtttctgggcaatatcgacagtcttatccaaaaattccctgagaacctcatccttcaacccatactcaaagagaaactggaaaagattcagccgtatatcattaagtcctacgtctataaaatgggaaactttattccagagtgccaaccatacgtcataaggaacctgaaggacaagaacaaaaccctctacatcggcatcgacctgtcccacgacaactatctcaagaagtctaacctcgccatcagcgccgtaaacaacttcggtgacattatctacctgaacaagtataagaaccttgagttgaacgagaagatgaacctcgatatagtcgagaaagagtacatacagatcctcaacgagtactacgagcgcaataagaattaccccgaaaacatcattgttttgcgagacggacgctatctcgaggacatagagatcataaagaacatactgaacattgagaacatcaagtacagcctcatcgaagttaacaagtccgtgaatatcaactcctgcgaagaccttaaagagtggattatcaagcttagcgacaacaatttcatatactatcccaaaacgtactttaaccagaaaggtgtagagataaagataatagagaacaataccgactacaataatgagaaaatactggagcaggtgtactcactgacgagagtggtgcatcccaccccctacgtaaactaccgcttgccctaccccctgcaagtcgtcaacaaggtcgcccttaccgagttggaatggaagctttatatcccttacatgaaatagtaactcgaggttaacttgt

SEQ ID NO: 290 - DNA, 2312 bp, Artificial Sequence
  Description of Artificial Sequence: Synthetic polynucleotide
ggtgtcgtgaggatccatgccaaagaagaagcgaaaagtggaggaccctaagaaaaaaagaaaggtgggctcagggagcatggaggcgtacataacggagatggtgtccagggagagggccaacgagctggaggtttacgtgtacgtgtttccacggaagcaatccgacaacaactacgagggtgtgtatcacataatgagggcgtggcaacgggctaatgacctgcctctggcgtataatcaacatacgatcatggcattttcccccgtgaggcatatgtgtggctacacgccgatggagacgcagaaacgccatattaacattgactccccattcgagagagccctgctggagcgactgataaagaacagcctgatttttacagccgagcgccatttgcatgccaagcgggtaggccatgcgcttcggctgaaccaggtgcagcaaatccggcaggtgatcatctatgaggccatcgagctctatgtaaatatcattgagaatagaataagcatcggctttcacctcacccaccagttcgagtacgtatacactctccagagcatgatagaacagggaaaaacaatcagacctggaatgcgcgtcgtgcattctaacggaaggcagcattatacctacaccgtggagaacgtagcaacatatggggtgaccgacagatgcccgctgctgcagaccagcatttaccaatactacgtcgaaaaaggcgcgcagcacattttgcgcaccttcacccgatccaccagggtgatccacgtaagaacgaaagagcagaggttgagctacgcggcgacactcctgaaaccgctgtgtacttttgagaccatgcaaccccaggacgtgctcaatgtcagcaagtgcatcaaacttagcgcgagcaaacgaatgaaatgtacttacaggtggattcagcaactccgggcacagtaccgacacctgacctttgcgccgaaccccttcacgatcgcccagaatggctataaacttgatcagctcagcacccccaaggtgcacttccacagagactacgccaccgtcgtgagcggaatgaagaccggcaagctttacaaaggcggtaatatcaagatcagcgtgctcttcgacgaggacttttacttgaaacaccacatcaccaagaaggacatatatcaattcattgcagtcctgcagaaaatcgccatcgcacaaggcgtgaacatgaccataagcacgagcaccaagtccattacgggcaagttcacggacgactttttccaccacttcaccgaggaggtcgaagcactgcagcccatcttcgcgcaaaccacagttctggcattcattaccagtacccacctgagcaacaagaaaaccaggagttaccagctgctgaaacagtacttcggcggcaagtgggacattgcctctcaagtcatcacggagaagacgattgaggcgttccaaaaaatcttgcacaagcacggcctgaagaatttctaccccaatgacgaacagcactgtctccgcgtgatcgatgtcctcaagaatgagagcttctactacacggtcatgaacatcctcttgggagtatatgtgaaaagcggcatccagccctggatccttgctaatacaacccactcagactgcttcatcggcatcgacgttagccacgagaacggaaactctgcggctgggatgatgaatgttatcggcagccagggccaccttatccaacaggcgcccctgaacggcatattggcgggagaaaagattgacgacaccctgctcgcaaacttgcttaaacaaatgattaaggcataccacacccagttccagcgctttcccaagcatataacaatccacagggacggcttttggagagaacacactgcactggtcgagaagatcatgagccactatgagattacctacgacatcgtcgagatcatcaaaaagcctaataggaggatggctttcttcaacagcgtggacaacacctttagcaccaggcaggggacagtgtaccaacggggcaacgaagcctttctgtgcgccactaaccctcagcagaaagtgggcatggcacaaccaatcaaaatacatcaggtgaccaagaccctgcccttctcacacatcatagaagatgtctacaacctcagcttccttcatattcacgctatgaataagatgcgactgccggccaccatacattatgccgacctgtctgccaccgcttaccagaggggccaagtgatgcccaggagcggtaaccagacaaatctgcctttcgtgtagtaactcgaggttaacttgt

SEQ ID NO: 291 - DNA, 2348 bp, Artificial Sequence
  Description of Artificial Sequence: Synthetic polynucleotide
ggtgtcgtgaggatccatgcctaaaaagaagaggaaagtagaagatccaaagaaaaagcgaaaggtgggaagcggcagcatgaccggcgagactaaagtgttggtcgggaggcaacccttcgacgtggatcggctgaatgaactcagagacgaattccgggagacgcacgtgttcagaagggatggcatcgacgatgtcattgttgatgttccggtcgtggccggacagaagcccatcggcaacgtccaggaggaaatagacctggctaggtaccaaaaggtgtggccctccctcctcagtgctgctcttgtccgggcgtttagcggcgtaagggacatcctgagcgataggcccgtgagcgtggtggggagcacactgcggggtctggttcaacatccggaactccccgaatggatgcagaaacgcacactccttaggttcgacacccggaccatctatgctggtgataaaagaacctttggcttggtgtgcgaggccagattgaaaaaccttatccaaggtagttgcgcggagctgctggcacttggagtttccccactgggtcgatatgtccaagtcgaggagccacattacgatcccaggcttatgaaaaaacggcgccttgtgggcagggtatcagcgatctccggcgataatctggtgctggaggaccatgccgagggctttccgaccgtgagtgcaaagctggcatttctggaggcgcgaagggagatttttgacgactgtgtgcggaggattttgaactctgatgcggcctccgtgctgaacaaggccgaagctactgctgcctcatttcactcagggccaggtaggaaagagcaaatagaggaggctctcaagtatctcagggagaaggtgagcctcgaagctgtacccggagcgaaattcgtgatcgggccgatgctgagtagcggcaacaagggcttccccatcacggagatgatcccgaaacccattctcgtgttcgatccgagcggtacacggaaggatgagtggaacgaaaggggcattaagaagaacgggccctacgaccagaggacgttttcacctaagcagttgaaggtggcggtcatttgccaggcgaagcacgaggggcaggtggatggattcatcgcgaagttcttggaaggtatgccagacgttatgacgggcaagaaccgagttgctagatatggtgacggttttctgcggcgattcgcccttgagaaaccttctgtgaccttcttcacagcgccctcagccaaggcgagcgattacctggtggccagccgggctgcgctgaccaaggcaacggacgagggtttcaaatgggacctcgcgcttgtgcaagtggaggaggagtttaagggattcgacgacgagagcaacccctactatgccactaaatccgtcttcctgaagcgagacgtgccggtccaaagtgtacgactcgaaaccatggctcaggccgacagccagctgattttctctatgaaccacatgagcctggcgacatacgccaagctcggtggtaccccctggcttttggcgtcacagcagacggtagcgcatgaactggttatcggtcttggcagccacagcgtggccaacagcaggatcggtagccagcaacgattcgtcgggattacgacggtgttctcctccgacgggagctatctgctctcagaccgcacggcggttgtcccctatgaggagtatgcgactgcgctttacgatacgctcaaacggagcatcactacggtgaggaaacaagacaactggaggtctacggataaagtccgcctggtgttccacatgttcaagccccccaaggacaccgaggccgaggctataaaacggacagtggacgatctggagctggagaacgtgactttcgccttcgtgcacatcgccccatctcatccctacctcatcttcgacaatacacaaaagggaattggtttccgagaccccaagaaggggatactcggacccgagagaggtctgcacttgaagctgggggactacgagtccttgatcgtattcagcggcgcaagcgagctgaaacaggcaagtgacgggatgcccaggccatgcctgctcaagttgcaccggcttagcacgttcactgacatgacgtatctggcgcgacaggcattcgagttttcaggtcattcatggcgaatgctctccccagaaccgttccctataactattaggtactccgacctgatcgccgaaaggctcgcaggtctcaacgccgtcccgggttgggacgcggaggctgtcagattcggccaaatcggccgcacgctctggtttctgtagtaactcgaggttaacttgt

SEQ ID NO: 292 - DNA, 2243 bp, Artificial Sequence
  Description of Artificial Sequence: Synthetic polynucleotide
ggtgtcgtgaggatccatgcccaagaaaaagagaaaggtcgaggacccgaagaagaaaaggaaagtgggcagcggcagcctgaaaatcaaaattctcaaggagccgatgctggagtttggcaacggcgctcacatatgccccaggaccggtatcgaaaccctgggagtgtacgataagagagatgaactgaggaggagcgagctgcgaataggcattgtgggtcggggcgagggcgtggaccttctggatgagtggctcgacaagtgcaagcgcggcatcgtgggtaaagaggagaccaagttccccaacttgttcaggggctttgggggcgtcgatgagtaccacggtttctacaccaagattctgagcagcccccagtatacccggactttgcagaaaagcgagattaacaacatcagcaagatcaccgcccgagaggacagggtagtgaagtgcgtggagctgtactacgagcagatccgattcctgtcagagaacaggagcattgacgtgatcgtgtgcgtcgttcccaatgatattttcgacagccttactaaggccaccggagacaaagacaccgagtccctggaggcctacctcgagcacaactttagacggttgctcaaggcccgctgtatgcaccttgggatacccttgcagcttgtgagggagaagaccatcctgagcgtgaagcctagcatagaccagcaggaccttgccacaaaggcttggaacttctgtacggccctctattacaaggggaataggactgtaccatggcgcctggtggaggataaattcaagcctaagacctgctacatcggcattgggttctataagagtagagacggcgaaacggtgagcacatcacttgcacaggtattcgacgagttcggccacggggtcatccttcggggagcaccagttagcctggacaaacgagacaagaggccctacatggacgagtctcaggcttacgaactgctggacagtgccctggcggagtacgagaaggccctgatgcaaaagcccgctcgagtggtgatccacaagagcagcaggttccggcccaccgaggtgagcggcttcagcagagtgctgaacgcgaaaggaatcagaacgaaggacctcgtgagcatcacatcaaccgacatccgcctgttcagcgacaaaaactatccccccacccgcggtaccttgttgtccctgtctgaaacacaaggagtactgtataccaagggaatcgtagatttttacaagacctatccgggcatgtatatcccttcacccctgagggttgaggcgttcgagtccgacagctctcttgaagacttgtgtaaggaaatcctgggcctgaccaaaatgaattggaacaacacacaactggacggccgactgcccattaccctggaatgcgccaataaggtgggcgatatcatgaagtatgtggacgcatccgaaaagccacaggttggtgtggcgctgtttatcttcatgttggagcaactcgtacccggctggaagctgcctaaggtgagtacatgggtagcacgggtaattttcctgaatattgtacaggtgtctatcgctctgcttgccgggattacttggaataaatggatgatgggccacagtttgttgcataccagcgatgccctgccccccttgctcgcaggattcgccgcctacttcgttaacaccttcgtgacctactggtggcacagggccaggcacgccaacgacaccctttggcgactttttcaccaactgcaccatgcgccccagaggatcgaggtgtttactagcttctacaaacacccaacggaaatggtattcaactctcttcttggcagtttcgtggcctacgtcgttatggggatctccatcgaagctggcgcgtattacatcatgtttgcggctcttggcgagatgttctaccacagcaacttgcgaacaccgcatgttctcggttatctctttcaacgccctgagatgcaccggatccaccaccagagggaccgacacgagtgcaactacagcgatttccccatctgggacatgctcttcggcacctacgaaaatcccaggagaatagacgaaccacaggggtttgccggcgacaaggaacagcaattcgttgatatgcttttgtttagggacgtgcattccctccccgggaagacacaaccagctcccgtactcgtcaaacccgacgtgaggtagtaactcgaggttaacttgt

SEQ ID NO: 293 - DNA, 2651 bp, Artificial Sequence
  Description of Artificial Sequence: Synthetic polynucleotide
ggtgtcgtgaggatccatgcccaagaaaaagcggaaagtcgaggatccaaagaagaagcgcaaggtgggttccgggagcaaagggcggcaccaggcgaaacactacgcggacggcctggaaaaaatgcacgggcaaaggcctgtgattttctacaccaacggccacgatatatggatatgggatgaccatccggctcagcactacccgcccagacggttgtacggattctacgcgaagtccagcctgcagtatttgataaggcagcgcagtgaacgcaaggcgctgaatacggtgagctctaaaaccgatatactcggagaaagactctaccagcacgaggcactgaagcggatctgcgaacgcttcgagaccaagcagaggaaggcactcgcagtccaagcgaccggcacggggaaaacccgcttgtccatcgcacttactgactcttgcatgaaggccgggtgggtgaaaagggtgcttttcctgtgcgaccgaagggaacttagaaaacaagctaagaacgcctttagcgaattcctcagcgcgcctattagcgtactgacaacgaaaagtgcgcaggatacccacaatagaatcttcgtggcaacctaccccgcgatgatgaaggtgtacgagcaactggatacgggattcttcgacctgatcatagccgacgagagtcaccgaagtatttacaacatctacggcgacctctttcgctattttgacgcccttcaagtgggcctgaccgcaacccccgtggagatggtatctcggagcacctgccagctcttcgggtgtgactttaagcaaccaacttctaattacacactcgaaacggctgtggaggagggttatttggtgccctaccaagtcgtgaaacataccacaaagtttctgcgcgatgggatcaagggccacgcgcttagcgcggaggaactggcggagctggaggacaagggcatcgatcctaacactcttgatttcgacgccgagcagatcgaccgagcgatctacaataaagacaccaatcggaaaatcctgcagaacctcatggagaacggtatccggcaggccgatggccagaccctcggtaagacgctggtatttgctaggaaccacaagcacgccaaactcctcgaacagttgttcgacgagctgtacccccagtacggcggtaagttctgtcaggttatagacaactacgaccccagggcggaagagttgatagacgattttaagggcgagggcagcaacgaacagctcactatagcaatctcagtcgacatgctcgacaccgggattgacgtcccggagatcgtaaacctcgtattcgcacggccggttaaaagccccgtgaaattttggcaaatggttggtcggggaacgcgactctgtaagaatttgtttggacccggcaagcacaagacgcacttccttattttcgaccactggggagtcgtggagtatcacggcatgaaacaacgcgaggtaactgtgtcccagagcaagtccctgatgcagcaattgtttgaaaatagattggagctcgccaagaccgcgttgcaccacgccgaagccgacttttttgagacgatggcggggtggctgcacaaaacgataaatagcctggacgatcgaacgattgccgtttgtgataagtggaaaactaagcagcaaatgtccgacctggagacgcttagacagttcggtgcaaacaccgtcacgctgcttgagtcagaaatcgccccgttgatgcaatggctggatgtcagagggcatagtgacgcatatcagtgggacctcctggtctcacagatccaacaacaaaaattgaagcaggcggcagccttcgatgatctcgctgggagggcaatcaatcaactgtggcagttgcagatgaatttgaatcaagttaaggcaaagtccgagtggattaagcagtgccgagagacggagtggtggcagaaggcgtccctggatgaactggaacaaatgcgacaagaactgcggggcattatgcagtacaggaacaagggtgacattccgaagacagaggcgcccatcatagacataacggactcagaggaggtgcgcgagaaacaatcctcctacctgaactcagttgacatggtcgcgtatcgggtcaaggttgaacaggcgctccaggagctctttgagagaaaccccatccttcagaagatccggaacggggaggccgtgtctgagcgcgagcttgagaacttgaacgctctcgtgcatacacaacacccggatatcgatctcaacacacttaaaaagttctatgggaccgcggctccgatggatcaaatccttcggacaatagtaggcatggacgggaacacggttaatcagcgctttgcggcgttcatacaacagtacccctcactgagtgcgcgccaagttcaattcctgtccctgctgaaacgacaaattgctcagagtggggccatagagattgacaacttgtacgaaatgccattcgcagctatcggcgaacccgacagcgtatttagtaacgcggaacagattgatgaccttctggcgattgtggagagcttcgggaagcagccccagcagcagtctacgagacaggccaatgagacatagtaactcgaggttaacttgt

SEQ ID NO: 294 - DNA, 3239 bp, Artificial Sequence
  Description of Artificial Sequence: Synthetic polynucleotide
ggtgtcgtgaggatccatgcctaagaaaaaacgcaaagtagaagatcctaaaaagaagagaaaggtcggctccgggagcatggattacatacttgaattcgacgagtttattcgaagcatcaagcagaatattgatacaaagtattcattcctgttgggggctggcgcttcagtcgaatcaggtattccgtgtgccagcgaatgcatctgggagtggaagagggatatcttcatcagccaaaatccgaccctggctgagatgcacaacaacatcaagagccagaacattaagcgcagcatccagaactggctcgataaccagggcacctacccaaaggagggcgaggacatcgagtattcctactatattgagaaggctttccggattcccgacgaccggaggaagtatttcgaacgaaacatcaccggcaagactccgtcactgggctaccatatcctgtgtctgctggcggaacgcgagataatcaagtccgtttggacaacaaacttcgacggcttgatcattaaagccgcccataagtaccagttggtgcccatcgaggtcaccctcgagagccaagatagaatctatcggacggatgccaacaaggagttgctttgcatagccttgcatggggactacaagtacggtccgctgaagaatagtaaagaggagctggacagccagtctgacatcttcgtgaatgccctttccttcgaggcgtctaagcgctattttgtggtgatgggatacagtgggcgcgacaaaagcctcatgcaggctattgagcgaagcttttgcagaagcggcgctggccgcctttactggtgtggatacggccggaacatcgcgcctgaggtacgcgtgctgatcgagaagttgaacttgtatggacgcgaagcgttctatattcccacggacgggtttgacaagacgatgttgaacatagcccatatgtgtttcgaggataaggaattgcaggaagaagtggagaaactcaaagcggatctcggtgcggggtatgagtgtcgcaccaccacgttcagcccctacaaggaaggggtgaataagatcgtggacacaaatgtttacccgatcaaattccccgacaagtgctatcagttcgaggtgaagaacagcagcgtaatgaacctctgggattactgcaagcagctgatagactataacattgtggccgtcccctataacggaatgatctacgcctggggaaaccgcaacagcatcagcaacatgtgcggaccaaatgtgaacgggacgatcgaactcgttcctctcactaggaaaatctttttcgacaacggcactctcaagtcaatgctccttaaaactttgctcatcgtgattggaaagcactccaattgcaagtataaccgaaacaaaatctggcgagagtccaagaaaatcaactacactattaacggcaaaaacattgaagcgtaccaaggcattaggtttagcttgttcatggactggaaatacagctacctcaccctgacccccgctttctactacaaagacaggaacaacgttagcaaggaggagaacaaagagttcagcgaccggtttatggagcaaatatgtaagatgcaagccaataagaattacgccgcgtacataaaacactggattaacattatctttcctgatggcaagtccatcatttccatgtacccgtgtaacagcgagagcggattcgagttcaccattgttaataagtcactgctggtcggactgcggagtaggcaagcactgcataatcctgacgatgacatgaagaaacggatttgcatcggtggagctgagttggcggacaccgagctcaagttctacaatccggctcagaatgcaatgcacaccgacttccaccccatgaggggccttatcaacaataagccctacgacttctacatgaataacaggctgtttaaatctaacatctccctgggcgtgatctctcctgtgggttcagagaaaaagctggaggacttcctggaccgactcaacaaaaagcacaaagtgaactacaacgtcgactatgtcatagattatcctgggtttcagtccgtctacggggttggcctttctgtccctctgatcgcagaatgggcgttgttggatgataaaatgctgaataaagccaacctgtatcagagctgccttaacttcggggatcagatcaagaagaagattgagtacctgaagagccgcgacagcgtggacgtgatcatcatatacattccgaaagagtacgagctgttcaccttcttcaacgacggaaatatccattatgacctgcacgactacgtgaaagcattcagcgtgcagaggcacattagcacccagttcatacgggagaaaacaattgactctgagcttgactgccagatcgcgtgggccctcagcctcgctatctacgttaaagcaggccgcactccgtggattctcagtggcttgaggactgataccgccttcgccggcatcggctatagtgtggaccatataaagaccgacaaccagacccttatcggctgtagccatatttacggggcagatggccaaggtctccggtacaagctctccaagattaaggatgtgaccttcgacagcaagaacaatccctacctgtccgaaaacgaggcctaccaactcggcctgaatatcaaggaacttttctttgatagcttcaagacgttgccccaacgagtggtcatacacaaaaggtttccgttccagaagcaggagatcgatggcctgactaagtgtcttgggtccgcgggagtgaaagacatagacctcatcgaaatcaccttggaggatcgatttaggtgctttgaatacgacaggcgactccagattgacggctaccccgtgaggaggggcgtgtgcttcgccatcaacgagaacaccgcctatctgtacacccacggtattgcaccaagcgtcaagaatgccaatctccgctacatacagggcggtaagagcatccctgcccccctgaaaatcgttaagcactacgggaacggcgacctggcccaaattgcgacagagatcttgggcctgtcaaagatgaattggaacagttttggtctgtatagcaagcttccgtgcactatccaatctagcaacgctatcgctcgcgtagggtggctgctctcccagtatgagggcgtagtttacgactataggaatttcatgtagtaactcgaggttaacttgt

SEQ ID NO: 295 - DNA, 2336 bp, Artificial Sequence
  Description of Artificial Sequence: Synthetic polynucleotide
ggtgtcgtgaggatccatgccaaagaagaaacgaaaagtggaagaccccaaaaaaaagcggaaggtgggcagcggcagcatgaacaatctgatgctggaggcgtttaagggcattggcaccatcaagcccctggtgttctataggtacaagctcatcggcaaggggaagattgagaatacctacaagacgatcagcaacgccaagaataagatgagtttcaataacaagttcaaagcgacgttcagtaagggagagaccatctacacccttgagaaattcgaggtcatgcccaatcttaacgatgtgaccattgagttcgacggagaagaggttctcccgataaaagacaataatgaaatttactccgaagtcgtgcaattttacatcaacaataaccttcgaaagatcaaactggataacaaatatcagaagtatcgagcaacgaataccagagagataactggcaacgtcatactcgacaaagacttcaaggagaagtacaagaagtctaagtcagggttccagctcaagcgcaaattcataatttcccccaaggtgaacgacgagggtaaggtaaccctgttccttgacctgaacagcagcttcgactatgacaaaaacatttaccagatgatcaaggccgggatggacgtggtggggcaggaagtgattaatacgtggaataataagaagcagaagggcaagattaagaagatttctgagctgacgatctcagagccttgtaacttcggccagtcccttatcgattactacgtttccctcaaccaagctgtgagggtgaagaactttacggaagaggaaaagaacacaaacgttatcgtcgtccaggtgggaaagggcgaggttgagtatattccgcacgcgctcaaacccatcattactagggagtacataaagaaatacgatgaggccttcagcaaagaggtagaaaacctgatcaaaatcaacatgtcatacaggtacgaaatactgaaaaagttcatcgacgacatcggctctataaccgaactgaacaaccttaagtttgagaacacgtacatagataacatcgagtcactgggctaccaacagggaaagctgaacgatcccgtgctgataggcggcaaaggcatcctgaaggataagatacatgtgttcaaatccggcttttacaaaagccccattgacgaagtcaagttcggcgtgatttacccgaaaggccacaccaatgatagcaagtccaccatccgggcgatttatgatttttgtaccgacgggaaataccaaggcaaggacaacatcttcattaacaacaaactgatgaatatcaaatttagcaaccaggactgcgtgtttgaggagtacgagctcaatgacataacggagtataagcgagccgcgaataagttgaaaaacaacgagaacatcaagtttgtaatcgccatcatccccgcgattgatgagagtgatatagaaaatccctacaacccttttaagcgggtctgcgccgagttgaatctgcccagccagatggtaagcctgaagaccgcgaaaagattcggcaccagcaagggtaataacgagttgtattttctgcataacattagcctgggtatcttgggtaagatagggggggtcccttgggtcattaaggacatgcctggggaagttgactgcttcgtgggcctggatgtgggcaccaaagagaaagggatccactaccccgcatgcagcgtccttttcgacaagtacggcaagctgattaactattacaagcccacaatcccgcagagcggcgagatcatcaagacagacgtgctgcaggagatcttcgataaagtgctgctgagctacgaggaggagaacgggcagtatcctcgaaacatcgtgattcacagggacgggttcagcagggaggacctggagtggtataagaactacttcatcaaaaagaatataaacttcacgattgtagaaatcaagaaaaacttcgccacccgcgtcgcgaacaacataaacaatgaagtgtccaacccatttaaagggagcttcatactgcgcgagaacgaggccatcgttgtaaccaccgacatcaaagataatatcggcgctccgaaaccaatcaaagtcgagaagacatacggcgatattgacatgatgaccataatcaaccagatctacgccctcacgcaaatccacgtcggaagcgcgaaatctatgaggctgccgatcacgaccggctatgccgacaaaatatgtaaatccatcgaatacatcccgagcggtagggtggacaaccggctcttcttcctgtagtaactcgaggttaacttgt

SEQ ID NO: 296 - DNA, 2354 bp, Artificial Sequence
  Description of Artificial Sequence: Synthetic polynucleotide
ggtgtcgtgaggatccatgccgaagaagaagcgaaaggtcgaggatcccaaaaagaaacggaaggttggctccgggtctatgggcaggcaactccaactgaactttaccccgctcagggttaggggcgacgccatcagacttcaggcgctgcctttcgaggacgctcaacaatttaggaatctgcgcgatgagcatcgagcacactacgctgtgacgagaaggagcgaccacatcgtggccctcccacttacactgaatgcctccccaatcggcgaggagaagatcgtgagcgttgtggagcatgcgagtttgattcggcccctgcttgaacagaggttggtgacccttctgtccagtaaccggaggccggtggcccggtataatccgatcaccaccattggaagaaccttgccaacgggcttcatagaagccgaccgacacctccatttgcagtcccgcgtgcttattgctatccgctccctcaagctgccggacgccgagcccttgggattgctctgggacatcgaaatccagaaaacatgcgcgactagccttgccgtcctgcacgcacaaggggtacggctggacggtctcacagtggaacggcttgtcccggtggaggacgtgcgaatgttgccttataggcgactggtgggcagagtaggcgcgctgaccgatggccacgcccgattgagcgagcggttccagaacgtcgaagaattgctgcccctggacgagctttacctggaggccagtccggagaacctgaggcaccttctgcagcatttcatgcgcaacacaagcgggcgagtgcaagggaagatagacgagatcgtcttcgagaactcacggggacgcgctcggatggagcacattgcccggatctccgactggcttagaggcctgggcgagattgaactgcaggagggtttgtctgtaggcatcggaaacctgctctctgaaaaggacgcccagaactttcccaggttcactgagggaacgaccccaacctacgtgtttgacgctgggacgttgaagagcgagtcaagggccgcagtgggcctcagtaaattcgggccctacagccggcatgtatttacaccgactcgacccaacgtttgcgtcatctgcgaccgcgcaagaagaggacagtttgagctgttcctgcggaaattccgggatggcctgactgttgatgggaagtccctgccgtttggtcgcgggtttctgggaatatatggccttcaggatatcaacctgaccttcgtcgaggcggatgcattcaccgcggacgcgtaccatgctgccgcaagcaaggcagtacggatgggagccgagggcgcaccgtggcacctggcactcgtgcaaacagaacgcgacagtcggcaactggctccccccaagaatccgtatttggtagcgaaggcggcgtttctgtctaatcaaattcctacccagtttgtggcgttcgagacattttctatggcgcctctgaacctcgcgtacacactgagcaacctggcgttggcggtttatgccaagttgggcggcatcccatggctgatcaagagtgataaaggtatagcccacgaggtcgtcatcgggttgggtagtgccgcgatcggggagtcccgattcagccggaaggagaggattgtcggcatcacaagtgtttttcggggtgacggcgggtacctcttgtctaacctgtccaatgccgtgcccatgagcaagtacggcgaagcattgaccgaatctctccaggcgaccctgcagagggttcgcaatgagatgaactggatcaggggggacagcgttcgggtcatagttcacgctttcaagccaatgaggaacacggaggtggagagcgttaaggctgcgctgaaagaattcagcgagttcgacctgcaatttgctttccttcacgttaagcaagaccacccgtacctcctttttgacgacgacagcatcggtacaaaagggcgaggcgagaaaacccccgtgcgaggcttgttcgcggaggtcggacacaacgagacactgctgaccctgaccggaccacagcagctgaagagacccaccgacgggctgccgaaaccgcttctgctcagcctccatagggactctactttcacagatataatctacctcacgaagcaggtgtactggtttagcaatcactcatggcggtctttcctgccagcagcgatgccggtgacgatatactacagcgacctggtggctggtttgctcggaagactggataggctggggtctcgctggtcaccgagtgtaatgctgggcaagatcggaaccacaagatggttcctgtagtaactcgaggttaacttgt

SEQ ID NO: 297 - DNA, 2954 bp, Artificial Sequence
  Description of Artificial Sequence: Synthetic polynucleotide
ggtgtcgtgaggatccatgcctaagaaaaaacggaaagtggaggatcccaaaaagaagcggaaggtcggcagcggctcaatggcctatccaatcgctgacgaccggcgaaagtacttccacagtcttttcgagaacaaggagccgtacatcggatacaaggctctgtgtctgctggccaagaacgacatcatcaagagcgtgtggacgaccaactttgacgggttgactgtgcggaccgcattccaaagtaacttgacccccatagaaataaccctcgacaacgcagacagactgtttaggaaccaaagcaagagagagctgctgagcatatcacttcatggcgactataagtatagcacgctgaaaaataccgagaaggagttggactcacaggacggcaccttcagcgagcatctgggtaactatcacgtcgacaagaacctgattgtgataggttattcagggcgcgacaaaagtctgatgaaatccctgaacgatgcattcaccaagaggggcaccggcaggctgtattggtgcggctacggtgacaagatcaacactgaggtggaagaacttatacgcaacgtacgaaccgctggaagggaagccttctacatatccaccgatggttttgataagacgctgatcgacctttctaaaagcgctctggaggacaacagcatgagcctcgaaagccttaattccatcctgaaactggcaaacaacgaggagctctcaaagatcgaatttagccagagcatcaccaggaccgacaaatacctgaagagtaatctgcacgcaattgtgttccccaaggagatattccagtttgaagtcgagtttggcgacaacaagccctggtcattccttaaagacaaaactaacaacaccgacatatgcgccatccccttcaagaggaaggtttacgccctgggcacgctcagcggtatatctagcgtgttcaaaaacgtgctcaaaagcgagattaggagggtaccaatctccaagttcgacatcgacaatgtgagcagctttaggtctctcatgatccaaacggtgatcaagcactttctgtcatacggaatcttcgacagcaacctcaaggacaaactgtggcttagaaattccgacaattccttcggggacaagaaaatacacaaggcgatttacctcagcttctacttcgataagagcagcaaattcggctacattagcttcagccccagcatacacataacctccgataacgagatcagcaaggaggtgaaacaaaggattagcaaagagatcttggaaaagctccgaaacgataagtttgacgaaatactggagtactggaacaccatactgttcaattacaaaaatcttaagttcgagtacccccttaacagcgggaccggattcgagttccaaataagccgaaacactgcgtttgccgaaatcatggtgctggacccgaactatcgagtctataaaccaagcgattacaacaacaagctgacccagttcagaggtgtgcagtatctggagccgcaactgatctttcagaactcactgagtaactcccacaccaaggactaccaccccatgagggcgttgaccaataacaggccatacgacaacaacttgaatggcatcatctattcaaacgaggtcaatttggccgtgatttgcggggaaaactactccaaaaacctctacgacttcctgaaccagcttaaccttaaacaccccacagacaacatcaaccccgatttccttatagaatatcctggcttcgcgagcgcctacaacctccccatcaacatcccatactatgaggacgcggacaagtggattaacatagatttggagaagagcaacaagtccgacagcgagaacgccatcatcgttgcacgcctcatcacaagcaaaatcgagcagatcataaacatacagtctcagcacaccatcgtcatcttcatccccaaagagtggcaggccttcgagagcttccaggaaaatggcgaggacttcgacctccacgactacatcaaggcgtttagtgcatccaagggcgtgagcacccagctcatcagggaggagacactgtcagacaggttgaaatgccaggtctactggtggctgtctctgagtttttatgtaaagtctctgcgcacgccatgggtcttgaataatcaggagaaaaacaccgcctacgccggcataggctacagcattaagaagaacagcaatgacaccgaggtggtgatcggttgcagccacatttacgattctaatggccagggcctgaagtacaagttgagtaaagtagataattacatcctggataagcagagcaatcccttcatgagctataatgacgcgtttcagttcggcgtgtcaattagggaactgttctacaatagcctggacaggctccccgagagggtggttatccataagcggaccaagtttacgaacgacgagataaaaggtattactgccagcctcaacatggcggggattaccaagatagatctcattgaaatcaactacgagacggaggctaggtttctctccatgaacgtattcaacggccttctgggcatagacaaattccctatcagtaggggtacctgcattattacgaataagtacgaagccctcctttggacccacggcatcgtgccctccgtgaagaatcccattcacaagtattacctgggcggcaggagcatcccagccccgatcaaaattactaggcattacggcgagagcgatctgaatactattgccatcgagatcctcggcctcaccaaaatgaattggaatagctttgacctttacagcaagctccctgcgacgattaactcctcaaatcagatagcccggatcggtaagttgctggcgcgctttgagggcaagacctatgattataggctctttatttagtaactcgaggttaacttgt

SEQ ID NO: 298 - DNA, 2369 bp, Artificial Sequence
  Description of Artificial Sequence: Synthetic polynucleotide
ggtgtcgtgaggatccatgcccaagaaaaagagaaaggtggaggacccaaagaagaaacggaaagttggctctgggtcaatgaacctgaccgtaaacctcgcccccatcagcgtgcagggcgactgctcagtcctgattggcagacagcgctacgacgagcagaggctggctgaacttaggtcagactttcggggcacccacgtgtttcggcgagacggtccagatagcatgattgacatccccgtggtccccgacgcggcacctctgggcaacctgagggagacgatcgaccttaggcggtaccagcggctgtggcccatgcttctgcaggagtccctcatccagctgcttggtaagcgccccatccagtccagcaagcccttgaagttcctgggagctaggtctcctctgatcgagcacccggatctccctgagtggttgaggcgggtgagcgttaccgagatccacacccgacacatcaccgtggacggcaagcaaatctacggtatcgtgtgcgatgtgagggccaagtcttttatcctcgccacctgcagcgaacttctgaaattcggcgtgaccatccttggtagatacgtccaaatagaacagcccgcgatagacgagagaaccatgcctaaaaggaagctcatcggcagggtaaggtccatccaaggggatgatctgcttcttgacgactgtgaggccggcttcgaaaaagtcgctgcgaatgaggcatttctcgagccgcggaaggaaaatttcgaggactgcgtgaggcaggtgctgaagcgggacgccgagagggtgttggagaggtcagctcgcgccagccaaaacctggccgcaggccctgggaaactggaacacatcgacggaatcatcaggtatcttagggagaagaagcccgcagcggtgcccggctgccatttcgtgatcgatgccatgctcaacacaaacggccacatttttccacccggggaaacaatggacaaacccttcctcttgttcgaccctagcggttcacggagagaagactggcccgagaagggccttaaagatcacggcccctatgatgagcaggtgttttcccccaagtccctgaagatcgctgttgtgtgccaaagccggttggagggcagagtggacgagtttctggcgaagtttctcaatgggatgccgaaggtctttcaacccggcaagagcttcgcccgctacggcgacggattcgtgaaacgattcagactgaacaagcccgaggtgcacttctttcttgcagatggcaactccgacgaggcatacgccgtggccagccgcgaggcactcgataaagcgagggatagcgggttcgagtgggacctggcgattgtgcaaattgaggaggagttcaagtcactggccgacggctccaatccctactacaccactaagagcatcttcttgcggagggacgttccggtgcagagcgtcaggctggagaccatgagcctgtcagataatgacctggtgttccccatgaaccacctgagcctcgctacctacgccaagctggggggcacgccctggctcctggctagctcacaaaccgtggcgcacgaactggtgatcggactgggtagcagcaccagctccgaatcaaggctgggcagccagatgagacatgtgggaatcaccaccgtgttcagcagtgacggcagctacctgctttctgatagaaccgccgcagtgcccttcgagcagtacccacaagagttgaggaaaacgttgcgaaaaacaatcgaggccgtcagggccgaggacaattggcggagtagcgacaaggtgaggttggtattccattcattcaagccgttcaaggacagcgaggtagaagccatagaggcgctgaccaccgacctgggcctgggcgacgtgaaggccgcctttctgcacattgcgcccgaccacccgttccttatcttcgaccacgaccaaatgggcatcgccgcacgagggggcaaaaaaggcgtgttgggccctgctaggcagttgcacatccggcttagcgacgctgagagccttgtggtcttcgcaggggccagcgagcttaaacaggtgacggatggtatgccgcgacccgcgctgctcaagctgcaccccaaaagcaccttcaaagatatgacctacctggcaaggcaggcctttgcctttagtgcccatagctggcggatgctgtcccccgaacctttcccaattactatccgctacagcgacctgatcgccgaccgcctggcgggactcgcgtctgttaagggctgggaccccgatgccgtgacgttcggcgctatcggtcacaagccttggttcttgtagtaactcgaggttaacttgt

SEQ ID NO: 299 - DNA, 2525 bp, Artificial Sequence
  Description of Artificial Sequence: Synthetic polynucleotide
ggtgtcgtgaggatccatgccaaagaagaaacgaaaagtggaagatcccaagaaaaaaaggaaagttggtagcggcagtatgataatgagcctggagagcaatatcttcacttttagcaacctcgggacacttaccacgcagtaccgactgtatgagatcagaggcctgcagaaaaggcaccaagagtactaccagaacaggcaaatcctgatccaccgactctcctaccttctgaaaaatgccgtaactatcatagagcgcgacgagaaactgtaccttgttgtagctgccgatgccccggaaccacccaatagttatcccatcgttaggggcgtcatctacttcaagcccaccggccagattctgaccctggactacagcctccgaacaccccagaacgaagagatctgccagaggttcctccatttcatggtacaaagtgccctgtttcaaaacgcgaatttgtggcaacccagcgccggaaaggctttcttcgagaaaaagccctcattcgagttcggatcaattctgttgtttcagggatttagcgttaggcccatattcaccaaggacaagatcggcctgtgtgtagacatccaccataaattcgtcagcaaagaacccctccctagctacctgaacttcaacgagttccaaaaatacagaggcgtgtcatgcatctaccatttcggccaccagtggtacgagatccaactctctgaactctccgagcttaacgcgacggaggcaatggtacccatcgagaataagttcgtgacccttattaactacatcacccagcaagccaggaagcccatcccggaagagctggcaaacgtgtcacaggacgcagccgtcgtgcactactttaacaatcagaaccaggacaggatggcggtgacgagtctgtgctatcaggtttacgacaactcttatccagaaatccgaaagtaccaccagcacaccattctgaagccacacatccgccgcagcgcgatccacggaatagtgcagaagtatctcgcggagctcaggttcggcgacataaccctgaaggtatcaactatccccgagctggtgccccaggagatgttcaacctgcccgactattgcttcggcaacgattacaaactgagcgtgaaaggaagcgagggcacagcccagattagcctcgaccaggtcgggaagcagcgccttgagctgctgagtaaggctgaagctggtatctacgtgcaggaaaagttcgaccgccaatacattctcctgccccaaaccgtgggggacagcttcgggagccggttcatcgacgacctcaagaagaccgtggacaagctgtaccccgctggaggagggtacgacccgaagatcatttactaccccgaccgaggtctccggacctacatcgagcagggtagggctatactgaaaacagttgaagagaacgagctgcagcccggctacggtatcgtaatgcttcatgacagtccggatcgactgctcagacaacacgacaaactcgcagctctggtcattagggagctgaaggactacgatctgtacgtggccgtcatccacagcaagaccgggagggagtgctatgagttgagatataacaaccagggcgagcccttctatgcagtaatacatgaaaaacgggggaagctctacggctacatgagaggggtggcgctcaataaggtgcttctcaccaacgagaggtggccctttgtgctttctacccccctgaatgcggacgtggtgatcggaatcgacgtcaagcaccacaccgccggttacatagtcgtcaacaagaacgggagcaggatctggactctgcccacgatcacgagcaagcagaaggagaggctgcccagtatccaaataaaggcgagcttgatcgagatcatcactaaggaggccgagcaaacagtagatcagctgcacaacatagtgatacatagggacggacgaatacacgaaagcgagatcgagggcgccaagcaggcgatggccgagttgattagcaggtgtacgctgcctgtgaacgccacactcacgatcctggaagtggcgaagagcagccccgttagctttaggctgtttgatgtctccaataccaattctaaggacccgtttgtgcaaaacccacaagtcgggtgctactacattgccaacagcactgacgcctacctgtgtagcacggggagggcgtttctcaagtttggcaccgtgaaccccctgcacataaggtatgtggaaggtacgctcccccttaaactgtgtttggaagacgtgtactatctgacagccctgccttggacgaaacccgacgggtgcatcaggtaccccattaccgtaaagatcaacgacaggaggcttggggaggacgccagtgagtacgacgaagacgccctgcgcttcgagctgttcgagtctctcgagtccgaggatgactttgacgagatgaccgacagcgactttaatcaggaggagacaatggtgtagtaactcgaggttaacttgt

SEQ ID NO: 300 - DNA, 1973 bp, Artificial Sequence
  Description of Artificial Sequence: Synthetic polynucleotide
ggtgtcgtgaggatccatgcccaaaaagaagcggaaagtcgaagaccccaagaagaagagaaaggtgggctccggcagcgtgggcgacaagaccttcagcttcaaggtgtataggaaactgaaacagcagaacgacaccaaggaagacgagatatacctttacaatttgccccaaggcgagaccctgaatgattacaagccatattggatcagttttaccccgaaggacggattcgaagaatacatcgctaattcttacttgagcatcggcctgtcaaaaaagtacctgttcaatagattcgtggagacgctcagcaactcaaaactgcacttcacctacaaggtcaaaaggaaattcaccgactggtacgtcgatttcgtaatcgcgcagtacagccagggagacaggatcatctacatgagcccctacttcctggaagagcaaaacacctacggcttcatcatcgacttcaagttcagcaagaaggatggtatccccttcgataaggaggtgcaaaagctgtccctttcactggatagcaacggccgcagcaacaaaaactattactctgacaaatttaggctggtgaacaatttcattaaggagatttacacctccataaagaacatcgggaccagtaataatcctatcaccatttccagcaacctcatagagaccaccgtgttccacctgaacaagaaagagtacatctttagcaataacaacgtaagctctagccagttccagggcgtgaggaatttcggtgtctataagaatatcccccaggacgtgatcttcgcgttcatattcgaggataggttcaggagcttcgccaacgagctgtatctgagccttaccggaaaattgaaccccgggacctttcccggactggagcagatgttcggcatcagcatcaacaccaaaaacgtgagacagatcaagttggagaactactctctggattcaatgcttagggtggtgaatgacgtgaagagcttgcaggagaacaatcccgataagaagatcgtgggaatctacgtggaagactgcaccatcgacagcgaggacatccctgcgtccaacaactactactttctgaagtatcactttatcaaaaatgacctgccactgcaggttgtgaattatcggaagctgggcgaaaggaattctctgaaatggagtacctccaacctggccctggccatgttcgcaaagatgggcggcatcccctgggtcgtaaaaccgtctaataagaactgcttgattcttggcatcggatctagtcataagataaaccgggagaccggcgatatacttaaatactttgcatacaccatatgtctcgactccagtggcctgtacaaggcccttgaggtgctggccgacgaggagagcgaggtgagctaccttgagaagcttactgccaatctggtcgccatactgaaggaacaaaagaccaattacggcacctgtgtgctgcacctgcccttcaagattaagaaaaaagaggtagccgccattagtgatgccataaaacaaatcaacgacatcgagctggtggtggtaaagatcaatgtggataacaagtatttcggatactccttccacaacacattggtgccctacgagagcagcttcgtgaagctttctaaggatgagtatctggtgtggttcgagggcctgctgtacggcaaagagatcgtagataagaggttgagcaaccccgtgcacatccaattcttgaacatcaccaacaggaagaacttcgatgagcaggcgtttctgcaggacattctgaatttgagcggagccaactggaggggcttcaacgccaaaagcatccctatctcaatttactattctcaaatcatcgcgaggtacaccgaggccttcgaaaacatcgacggttacaaggagggtactatctctaacgacaaaccctggttcctgtagtaactcgaggttaacttgt

SEQ ID NO: 301 - DNA, 2312 bp, Artificial Sequence
  Description of Artificial Sequence: Synthetic polynucleotide
ggtgtcgtgaggatccatgccgaagaaaaaaaggaaggtggaggacccaaagaagaaacggaaagttggcagcggctccatgagcgtggcgatcgtgagcccccaaatgtacaagagtctgagcgaggtgtttcctctgaccgcctcccaactgaactttatgtgctttaggctgactcccgaaatcgaaaagaaggatggtaataggctcagctaccatttcagtctgaagctgccggaaactgttgtgatctggcaccagccctacttctgggtgttggcgagtagtaacaggcaaatccccaataaggacgagttgcaagaaactctgataaggatccaaaacgaggtggatgacttcaaagaacgactcttcggtttccagagcgttcgccacccccaactcaccccctttatcatcagcctcttcgccgtgcaggtcctcaaaaaaacaaagttcgactaccccattgcattcagcaacaacggtgtaatcgtcaggagggagcccgacttttggacggagagcatagagcttcaagacagcctgcatcctgccctcacgctgaccgtaagttcatcaatagtgttccgcgacaacctcgcggagttctatgaaaaacatcatcaaagggagaagcccgagcagtttctgatcggcctgaaggtgcaggaaatagagaggggcaacaatgcgatcatcgtgggactcgtcggcaccatcggcgagcaccgggaccagctgcttgaaaaagcaaccgggagcactagcaagcaggcgctgcgagaggcaccggacaaccagccggtggttgcgatacagttcggcaaggatacgaagcagttctactacgcaatggccgcgttgcggccgtgcgtaacctcagagacggcaaaccagttcgaggtagagtacggtaagctcctgaaagctacaaagataagccaccaggagcgaaccaacctgctggcctcatacaagaagacggcccaggagtcattggccgcttatggcatccgcctggagctgagtgtgaatagcagggattaccccagcttcttctggcaaccccccgtgaagatcgaagataccaaacttctgtttggcaacggcataaccggcaagcggactgaggtgctcaaggggctttctatagggggcgtgtaccgacgccacgggaaattccaggacaagtcaaaagtgatccagatcgcggctcttaagctttgcgacgtgaccgttagcttgttcctgaagcaacttactcaaaggctggcaaaatacggcttccgaagcgagataatcaccaagaagcctctgtcaatcaagaaccttgccaccgccgaagccagggctgctgttgagaaagcggtcaatgagctcgtggaaataccccacgacatcgtgcttgccttcctgcctgagtccgacaggcacaccgacgacacggatgagggttccttctatcaccagatctactcccttctcctcagaagacaaatagcctcacaaattatctacgaggacaccctgtccaactctgggaactaccagtacatcctgaaccaggtcattccggggatcttggcgaaactcgggaatctgcccttcattttggcggaaagcctcgatatagcggaccacttcatcggacttgacatcagcagaatctctaagaaaacgcaggtcgggacacgaaacgcgtgcgccagcgtgcgactttacggacgccagggtgaatttatccgctaccggcttgaagacgacctgatcgacggcgaggcgattccacccaagctgctggaaaggttgctgcctgcgaccgagcttgcgaataaaaccatactgatctacagggacgggagcttcgtgggcaaagaggccgactatcttgtggagcgagccaaggcgatagacgcgaagtttatcctcgtcgagtgtaagaaatccggcgtgccgcgcttgtataacttggagcaaaagaccgtgatcgcgccgagtcagggactggctcttcgactgagcagtagggaagcaatactcgtgaccaccaaggtgcccgataaagtgggcctggctagacccatccggctcacaatccacgaaaagggccatcaagtaagcatcgaatccgtgctggacactacactcaagcttactcttcttcaccatggcgcgctgaaagaaccgcgactgcccatgcccctgtatgggagcgacaggatggcatacctccggctgcaggggatacggcctagcgttatggagggcgaccgccaattctggctgtagtaactcgaggttaacttgt

SEQ ID NO: 302 - DNA, 3257 bp, Artificial Sequence
  Description of Artificial Sequence: Synthetic polynucleotide
ggtgtcgtgaggatccatgcccaaaaagaagaggaaggtagaggaccctaaaaaaaaaagaaaggtaggttccggatccatggaagaaaatctgtatcttgaatacgacgctttcttgaggagtgtgaagcgcaacgtggacgtccctcatagtttcttgcttggagccggagcttccatctcctccggaattcagtctgcatacgactgtatatgggagtggaagagagatatctacatcacgaagaatataaacgccgccgagtactataaaaatcataaaaacgaaacggttcgcaaatcaatacagaagtggctggacaaccatggcaactaccccatcctggatgcagcagaagagtacacattttacgccgagaaagctcatccaatcgctgacgataggagaaagtacttctttagtctgattgagaataaagaaccatatatcggttacaaattgctgtgctttctcgcttcacaggggattgtaaagagtgtatggacgaccaattttgacgggctgattgtacgagctgctcaccagaataatttgacgcctatagaaatcaccttggataacgcggagcgcatattccgaaatcagagtactaaggagcttctctgcatagctctgcacggtgactacaaatatagcaccttgaagaatactgataccgaactggataaccaacacgaaatttttcaggagcacctcggaaattatcacgtagataaaaattttatagtagctggttatagtggacgcgacaagtctctgatggatgcactcaaggccgcttattccaagaaaggatctggtaggttgtattggtgtggctatggtgagaagataaattctgaagtgaaagatcttcttaagtatattagagcgagtgggagggaagcatactatatagctacggatgggtttgacaaaatgctcatacacttgtcaaaggcaatatttgaggatagccaagagctgagtgaaaaaatccagaaaatactcgaaagcacgaatcaaaccgagaccttcaacacagaattcaagttggagtttaaaaaaaccgacaaatatatcaaatcaaatctgcaccctattgtttttcctaaggaagtatttcagttgcagatcgagtatggcaatgaaaaaccgtggtccttcctgaaaacactgacaactcaaacgaacattagcgccgtaccgttcaaaggcaatgtctacgcacttggtacgcttagcgagatcaattccatcttcaagccgtatcttaaaagcgaggtcaagagggaagcgatcagccgattcgacatcgaaaacgtcaccgcattcaaaaacctcatgttgacagccatatccaaatatttttgctacacgaaagaagtgaactctaactacaaagataagatttggttgaaaaacatcctgtccaaggtgggggatatcactgttcacaaagcaattttcatatccctgtactttgacaagaattcccattttggttatatggcgttcgctcctaccgtttatttggattccgactgcgaaattgagaagagtcaaaagcaatccatcagtaagaatttgcttgagaagttgtataataacaaatataacgaagagctcgaactgtggaatggtatcttgtttaatcataagaaagtgaaatttgaatatcctcccttgtctggtacggggttcgaatttcagatatcaagcaacactgccttcggggagatagacgtgattgataacaagtaccgctcttacgtcccccagaattatgataataagcagactcagttccggggaatccagtttttggagccgcagctgatatttaagaacatcgcaacgaactctgacttcaaggattatcatcccatgcgaggactgattaacaaccgaccatatgatgtaaatctcaacgggattatccactccaatgaaattaacctctcaatcatctgtagccaaaagtatggagaaaggttgttcgcattcttgacacagctcaatagtaagcacagtacagaaaatatcaacactgactacctgatagattaccccggcttcctgtccgcctttaatctgcccatcaacatcccagccaccaacgatgacgctagctggatggacatcaacttcgtagcagataactctaaagaaacacacgagaacgctatacgactcgcgagggcaattaccaataagatcgagaagatttctgctatacaaagcgccagcactatagtaatctttatacctttcgagtggcagcccttcgaaacatatattaacgaaatagagacgtttgatttgcacgactacattaaagcgtttagcgccagcaaggggatatcaacgcaacttattcgggaggacacccttgacgataagctcaagtgccaaatatactggtggttgtctctttctttttacgtgaagagcctcaggaccccatggatattgaacaaccaggagcggaaaacagcttatgccggaattgggtactccataagcaaggtaaagaacaagtcagagatcgtgatcggatgttcacatatatatgattcaaatggccaaggccttaagtatcgcctctcaaaaattgataactactttctcgataagcaaaataatccgtacctgtcttataaggacgcttttcaatttggggttagtatcagagagctcttctatcagtcactcgattctctgccagaaagggtcgtcatccataaaaggacaaaattcaccgaggatgagatcaatgggataaaggcttcactcaaccaggctggtattaagaagattgatcttatagagatcaactacgatatagatgcaaaattcgttgccatgaacgtgttcgataacaaattgcaggtcgataaattcccgatatccagaggaacatgcattgtgacaaataaacggacggcgttgttgtggacgcatggtatagtaccttcagttaagcagcccaattataagttctacctgggcgggcgctctatccctgcgcccataaagattaccaagcatcacggagaaagcaacattgatgtgatagctagtgagatcctcggactcacaaaaatgaattggaatagcctggatctctacagtaaacttccctctacgatagattcttctaaccagattgctaagataggaaaacttctgtctcgctttgagggccgctcatatgactacaggctgtttatttagtaactcgaggttaacttgt

SEQ ID NO: 303 - DNA, 2318 bp, Artificial Sequence
  Description of Artificial Sequence: Synthetic polynucleotide
ggtgtcgtgaggatccatgccgaagaaaaagcgaaaagtggaagaccccaaaaagaagcggaaggtgggcagcggcagcatggacaatttggctctctctgcgcttcagctggacagtagattggatcactgtatggtatatcaatacaggatcgtgtaccataagttcgacgaaacagaggcgggtgaaaaactggcaagaaaggccgcctacgaactgtggaaggtaaacaacttcggactgctcaccaacctgggtgccagtagcatcctgtcccttaagagcctgagtcagctgtctatcgattcaccgctgttgcaggcaagtttgaaagctgacggccagttggagctggattgcggtaacgaacagcatcaggaggcgctgcagagactcgtgaaccaggacataaacaaagcggcttggaacctcaaacaagcgagcgaggggaagcttgattgccgaaaatcaccaggcgggcacgccgaaatcttcgagccaagtcacagtagtcggatcaaggcccacagtacctatttggatgccttctgcaccgtaaggctgattcccgaagtgctgtcagacgggacagtgctgatagggttgcatcttaagcacagcctgaccgcgaaggcggacatctctcttcagtgggtcattgatcataggcccgattggctgatatccatagagaaggtgcgccacaggtattacgagcccggcaaagcacccctcgttgcggagttcgtgaaagtcgatgattccatcaacggatcatcccttctcccacacttgggcaaatcccttgtcgcttaccaccaggagaaagggctgctttcagccggacagctcgcagaggcagccaccagctcactcatcaaagtgcgctacggacagaaggaggcagaccacgttgctagcttggtggaacccatgtttgatttcgatactctgtcaaagattgacagccccttcctgaataggctcgccaaagacctgaagtggagcttggacgatagaataaagacaagcgcggagatggtcaagaggctctacctgcccgggtttaatcgaaagttggtacaagttgactaccagaatctgagcaggaagaggttcaaccacaaccttatgctccagttcgcggatggggcaaggagcggccatgaacaagacgtcctgaaatacaaggctttcgccgacatgaccagggctagggtaatcccactcgtggtaggagagaggaacaacaccgaaagcaatagacaattgctccggaacgcctataacgcactgaggcaacttaccaaggccgaattgccccccttcacgtcatttccccccagcatcggaaacgccgacgagttggacgcacggctgcacaagaaatgtcccgacaacgccatcctgcttatcgggctcacagagaagagtgacaaagccgcgatcagggacacggcgttcaactacggcctggccacccagttcatgaggctcgatcacaagcccaaggtttacgacagcttctacttcaataacgtcgcagcgggcctgttctccaagggaggagggcaactgtgcgccgtgaacgacatgcccggtgagactgaactgtttatcggtctggacatgggcggcgtgaatgtaagggcgccaggtttcgcattcctgtttctcaactctggcgcgcaactgggctggcagctggctgacaagcagcagggcgagaaaatgcaggacgacgctctcagcaatctgctggagaagtctctcaaaacctacctgaggagcaccgacgggcttttgccaaggaggataactctgcacagggacggcaggttttacgagagcatcaatgtgatagaacagtttgagcagaagcacggggtcaagctcgatgttctggaagtcttgaaaagcggagccccggtgctgtaccggagagaacgcagtgcggacggtaagaaagttttcagcaacccaggggttggcgatgccgtcttccttagcgacagggaggtcattcttagcacttacagcggcgaggaacttgggaagtcatggggtaacaaggtgagtgtgaggccacttcgactccgaaagagatacggcgagaccgcattgagcgtgttggcccatcaggtgttggtcctgtctaggatccatggggccagcctctaccgacacccccgacttccggtgaccacccaccacgcggacaggttcgcaaccttgcggcaagatgcgtgcatagacgcacttagtaagatggatagactgtgtccggtgtatctgtagtaactcgaggttaacttgt

SEQ ID NO: 304 - DNA, 2333 bp, Artificial Sequence
  Description of Artificial Sequence: Synthetic polynucleotide
ggtgtcgtgaggatccatgcccaagaaaaagcgaaaagtggaagatccgaaaaagaagaggaaagtgggcagcgggtctatgaataacgtgatgcaggagtttcccgtcgcaagcttccccacattcttgtccgagatcagtctgcttgacatcacaccgaagaactttatctgctttaggctcacccccgaaatcgagcgcaagaccggtaacagttttagctggcgcttcagccaaaaattccctgacgccgtcgtgatttggcataacaagtttttctgggtactcgctaagcccaatagaccaatgcccagccaggagcagtggagagaaaagttgctggaaatctgcgaggaacttaagaaggacataggcgacagaacctacgccattcagtgggttagccagccccaaataacccctgagatcctgtctcaactcgccgtcagagtgttgaagatcaactgtaggtttagctctcccagcgtaatttctgtcaatcaagttgaagtgaagagggagatcgacttttgggccgaaacaattgagattcagacccagatccaacccgctttgaccatcaccgtgcacagttcattcttctatcaacgacacctggaagagttctacaataatcacccttacaggcagaaccccgagcaactgctcatcggcctcaaggtgagggacattgaaaggaatagcttcgcgacgattactgacattgtgggcaccatagcggaccaccgccagaagctgctcgaggatgccactggagctattagtaagcaagcccttatagaggccccagaagagcagcccgtggtcgccgtacagttcggtaagaaccaacaacccttctactacgcaatggccgcgttgcggccttgtatcaccgccgagaccgctaggaagtttgacgtggactacggcaaactgctgtccgccaccaagataccctacttggagcggaaggagctgttggctctctacaaaaaggaggcgggtcaatctctggcgacttatggtttccaattgaaaatcagcatcaacagcaggaggcatccggagctttttttcagcccaagcgtgaaactgagcgagaccaaactcgtattcgggaaaaaccaaataggggtgcaggggcaaattcttagcggattgagcaagggtggggtgtacagaaggcatgaggacttcagcgacctctcaagacctatacgcatcgctgcgcttaaattgtgcgactaccctgcgaattcatttctgcaagagacccggcaacgcctcaaacggtacggttttgagactctgctgcccgtcgagaataagaaaaccctgctggtagacgatctgagcggggtcgaagcacgcgcgaaagccgaggaagccgttgacgaactgatggtgaaccaccccgacatcgtgctcactttcttgccgaccagtgataggcacagcgacaacacggaaggcggctcattgtatagttggatttattcccgactgctgcggcgagggattgcttcacaggttatctacgaggacacgcttaagagtgtggaggcgaaatatctccttaaccaggtgatccccggaatattggcaaaactcggcaacctgccgttcgtacttgcggagcccctgggaatcgctgactacttcataggcctggacatctccaggtcagcaaagaaacgggggtctggaaccatgaatgcctgtgccagcgttaggctgtatggtaggaagggcgaatttatcaggtacaggcttgaggacgcactgatcgaaggggaggaaatacctcagcgcattctggagagttttctgccagccgctcaactgaagggcaaggtagtgctcatttacagggacggccgattctgtggtgacgaggtccagcacttgaaagagagagcaaaggctataggaagcgagttcatcctggttgaatgctacaagagtgggattccacgactgtataactgggaagaagaagtcataaaggcaccaactctgggactggcccttaggttgagtgcgagagaagtgattctggtgacaaccgagctgaacagcgcaaaaatcggtcttcctttgcctctgcgactcagaattcacgaagccggtcaccaagtatctctcgagtctttggtagaagccacactgaagttgaccctcctccaccacggcagcctgaacgaaccgcggctgcctataccactgtttggttccgatcgaatggcctaccggagactccagggcatatatcccggattgttggagggggatcggcagttctggctttagtaactcgaggttaacttgt

SEQ ID NO: 305 - DNA, 2276 bp, Artificial Sequence
  Description of Artificial Sequence: Synthetic polynucleotide
ggtgtcgtgaggatccatgcctaagaaaaagagaaaggtagaagacccaaagaagaagcggaaggtgggctccggttcaatgaacctgactctgttcaacgagatcctccccatcaacatcagccaactgcccaaccagtacttctacaagctgtgcactgccggcgacgtggacctggattctctgggcaggagcatcaagtaccggatccagaaatacttcagaggaatctgggtgtggagtaccaacgaccaactcctcatttcagacaagctcatcgagtaccccgaactgcaaaagttcacccagtatctgtggaccgaccagtctaacctcacattcaaccagctcgaggggatagaaatcgagaacattaggtgttgcaccccccaaggcatcgctgatttctgtagccaaggtctcatcaaaaagtacgaccagcagatcaagaagatactcgaacagtccaagacagcacggagagactatcatatcaaactgatccacaagttcggctcctgggtggtgaacaatcagccctgcataagcctgagcctgaaacaggagatcgattttaacggaactctccaggactacctgaccaagttccccaactctaacatcatcggcctgcatgtgctcgacatcactaagcctttcaacaccgcacaggaggtcatcaagattctcggtatcttgggtgagggaaatcggcggcagcgcctcctgacttgggtcaaggagccaaccatgaaaaaactcgtggaagaggccccagatagtgagctcgtagttgagatcgggaacaagaaaaaatcctatcattacatcatttctgccctgcgcatcagagtcctcaaccaagattacctgaggctggggattagcgagaagctgcaaatagtcagtgaagagaggttgaagtacatcgagccacttttccgcatactgcaatcagagggcttcctggacaaggtgtatactagccagcgcaaccccgagctgtttaggtcatgcagcgaggaatggggttacaatcccctgctgaagttcaagaataacgccactgttgcggcggaatccgtgcagtccacggtccaggtggtgcagaaacacggcgaattcaggaaagccgacaaaagcgaaattaggatcgccatactcaacacactgaagagtgaaaacagcaccaaattgattgagattttccgaaacaactttaagcgaagctttaaccagaatttggagggaatcggtaatcagcttaagtataaactcaagttggtgggccagcccattgcactggatctcagtaagaactccctcagcctgctggacagcaaaataggagaattgtctaaaaagaagccggacattgtgatctgtgtgatccctaacttccttagcaagggcgaagacgggcggacactttacgacgatttgaagcagacgttcctcaaatacaatctccaatcacaaatgttgcaggagaagactctcacgacgtcatttgccacaaagaacatcgtgttgggcgtgctggcgaaaattggaagcgttccctatattctgcaagaaccgctgacgtacacggactttgtcgtaggtttggacgtgagcaggcgacgcaaaaaaaacctgcaaggaaccaacagcgtagccgccatgacccgaatctacagcaatcaaggcgaactggtccactatagcatccgagacgcaaccatcgacggcgagatcattcccaagaggatgctctacgacctctttccacttcacgaatatcagggcaaacgcgtggtgattcaccgggacggaaacttccccgaggaagagcgccaggcactcgaggaaattgccgaaaagattgacgcgaagttctacttcgtaagcattatcaaatctggcaatcccaggatctacggtaggaccaaaaacgaagagggcatcggcagttatcgcaaggcacctaagggtagcattttcctcctcagcgagacggaggccttgcttatcagcagcgactttccggaccgcttcagggccacgccacagcctctcagaattaagacgtttggcaactttccccttcaaagcgccgtccatagcgttctgtcactcacctacctgcactacggttccgagcgcccaccgaggctgccggtgtctacctactacgcagatagcattagcactatggtatccaagggcattaagcccaaggacgttgacggcaatatacccttttggctgtagtaactcgaggttaacttgt

SEQ ID NO: 306 - DNA, 2348 bp, Artificial Sequence
  Description of Artificial Sequence: Synthetic polynucleotide
ggtgtcgtgaggatccatgccgaaaaagaagcggaaggttgaagatccaaagaagaagaggaaggtggggtctgggtcaatgctccttaatcatctcccaatcgagttctccagcgcacagttcgctggacacgaaattgcttatgtcgacggcgagcagttgaggtccatacgacagagactcacgcgcacgcacttcgtgttgagggatggggacaatgttctgctcttcccgtacgaacatggaaccgcgaccgagggaaccaggcgaacattcgacacgggcgttaatttcagcgtagccaacgccctggcgcgcaacggcatgcttctgcgattcttccagcactctagaagtatttccggcgtccgaccggtgaaatttgtgaaagacaaccagaacctgctcacgggtgacgtaggccggttgtttgctatatgtccggagtacagtttcgacatccgacccctggcacctcaagacggcagccttgtgaacggggtactggtaaacttctcagcccgatttttggtgaagccctccctcgacgaattgattgcgcaggggctcgacccacggggcctgtatgttgttaaagaggcagaaagagaatcaccctacatcctgccgatgtttaatcggagattggtagggcggatccaggacgtggtcggaggtatcgccaagctggtggacgagcgcgaacaggacctccctgtacatgaacttcatgtcgaggccaacctggtcaacttcgagaaagtaggcagagcactgcttggccgggattacgagcgagtgagtcgacaagtgcttcccaccctccataaggtgagcggcgcagagaaacagctcgatcgcttggtccagctgctgacgagcttcaaagacctccagggtgacatcccgtgttgcgacggcctgaccgttagactggcaggcatacttacagatgtgcccttcggcagtgaggtgggccaattccgcaaattgtccgcgccacagtgcagcctccgcccagggggaactattacggtgccgtggcccgtggacggcaaactcaatgccaacggcccctttgatgcagacgccttcagcaggaaggaaccaacaatcggcgttctgtttccggagcagcacaagggtagtgtagaagagctggccgctaaactcagagacggcgcaccgagcgatggaaagtacccaagtccatttccccaaggaatgccccggaagtatagacttaggaagatgacatatgagctgacgcccacgaaagtttcaggggacagggccgcagcctacaagaatgccgcgcttgcagccgcccaacaagagcttgatctcgctctggtggtcatatctgaatcagataaggcgttgcttggagccgccagcccctactacactgcgaaagccacattgatgagccaaggcgtgccggtgcaggctattaccattgagactatcaacaggctcaacccctacaccttgaataatctggcactttccctttacgcaaaactcggcgggataccttggaccctgtcagttcaacagcgactggtccacgagataattgtagggatagggtctgcgagagtgggcttcgaccgcctctcagagcgggagaggcttgtcggcatcacgaccgtgttctccggggacggatcataccttcttggcaatgcaacgacggaagccagcagtaccgaatataggtctcgccttctggagagccttagggcgactttggcagagttgcgaagacgatttggctggcagcggggagataaattgaggattatcttccaccaaagctataagcggtacaaggagaccgaagcaaccgccgttagcgacctcatcgccgaacttgatgaattcgatgtggaattcgcgtttgtgcagatcagtagcgatcatgactggaagttgttcgatgagagtgccacaggcgttacgtatcagtcccggcaaaagggagcgaaggtgccggaacgcggagtcatagtccctctcggacctcgcgctgcgctgatcacgttggtgggtccgcatcaactgaaaaccgacctgcaagggtgcccctcccccatactggtgtctatccacccgagctcaactttcaaggatttgagttacgtgtcaaagcaggtgttcgacttgacctttatgagttggcgaagctttaacccaagcacgcagcccgtttccgtgagttatcccaacatggtggtggatctgctcggtaacctgcggcaaatccccaacttcaatcccgacattctgacgacaaaactgagggagtctaggtggtttctgtagtaactcgaggttaacttgt

SEQ ID NO: 307 - DNA, 2228 bp, Artificial Sequence
  Description of Artificial Sequence: Synthetic polynucleotide
ggtgtcgtgaggatccatgccaaagaaaaaaaggaaagtcgaggaccccaaaaagaagcgaaaagtgggcagcggctccttggacaattacatactgaccgagtacaaggccggcatccacgccagcgagatcaagatacacatctaccggatgcccgtcaaggatcttgagaaaatcgactatgagtacgggaagtacacacgcgacctcagacaaaaaaacaggaagacgatatccttttaccgctctctgatcggcagctttgagaagctcaccatcgtgcccaagggatacgagaagtacgagtatagatcaattaaactcgaccagagtgaggagtcactccaggagaggaaactgctggagaggctgatcttcgacggccttagggacagcaataggaaccactttatgagcaccgagcagagcatcatcgagaaagagcccatcaagtccctgagcaagtgcaaaatccaccggggtatctacatagacatcaccgtgaaagagaaaggcgacatcttcatcggtttcgagctgaagcactccatccagagcacccacacgattatcaaggctctgaaggagaagaaactgaacaagggcgataaggtgtttgactttctgaacagcgcccactacgagttcgaggggattagcgacaaaaccatcagcgacccccttcccgaactgggcaacaagagcattatccagcactacaaaacgaaacccagcatctactgccacctcgtgaaaaaaccgaacatgcccgccatcctggtacgcagcaagagcggcaaggtgtatccttaccccccacagctgcttaagaaggagtgcctgatgaaggatgtgccggctaaggagcacagctctatcaagctgaaccccaacgataagatcaactacagcattgagatcatgaagagaatcatagatgcgttcgagaacaggtatttccccatcggctttgaaaagaacaacctgaacatcgccaagctcggatacaggaggaggctggtcccggatcccctgctgaggattggcaacggagccacctgcaaccacagagacctcaagggtgccttccttaggcacaagatttatgacagcgtgagctcccctatctactaccagcttctgcttgaccaacccttcgaaagggagtggcagaaaaagatgagcgaagcgttcattacgaagatggaaaaccggagcaggcagtggggcataaagcttcagtgtaccgggaaccagatcctccctacctctaacccgtacgcgctgagactgcatcttaaggacatcaacctggataccgacatcattagcgtggtcctgttggacgagaccaaacaagaaggcgaggaggtttactctaccatcaaaaaagagctgggtggcaccaggggcgcacatacccaggtaatcctgatcgatagcctgaagaacgaatacactatcccccagatactgttgggaatctacaccaaggctggattgcagccctgggtcttgcaccagccgttgcacgccgactgctacgttggctacgacgtgagccatgaaaatggcaggcacaccactggcatagtgcaagtgttcggcaaagacgggtcacagatcttcagtcagcccattagcagcgcggaggccggagagaaggtgtcaaaggagaccattcagactatggtgatacacgttctttactattaccagaagaaagttggcaagatgccacagcacattgtcttccacagggacggccgaggatacgtagaggagatagactggattaaagacatattgagtaatagggacctcaccaacggccaaagcatcgctttcgattacatctcagtgatcaaagagtgtggtcggcgcatggcttactttgacgacataaagaagaagtatgtgaacgtgcccgggattgcctacctggacgacaacgcccaaaaggcctatctttgcagcaccaatccatacgaaaaagtagggatgagcaaacctattaagattgtgaagaagattggcgagatgaccctggagcagatcgtagaagacatctatcacctgagttttatgaatatcgacaccgataggaaggtgaggctgcccgtgactaccaattacgccgataagtcttcaacgtttttctctcgcggctatctgtcatcacaaaagaaaggaattggcttcgtatagtaactcgaggttaacttgt

SEQ ID NO: 308 - DNA, 2354 bp, Artificial Sequence
  Description of Artificial Sequence: Synthetic polynucleotide
ggtgtcgtgaggatccatgcccaagaagaagagaaaggtcgaggacccgaaaaagaagcgaaaggtaggtagtggttccatggtcggcggctataaagtcagcaatttgacagtggaagcgttcgaaggtatcgggagtgtcaacccgatgctgttttaccaatacaaagtcaccggaaagggaaagtacgataatgtgtataagattatcaaaagcgcacggtacaagatgcattctaagaaccgattcaagcccgtgttcatcaaggacgacaaactgtacaccctcgagaagctcccggatatagaagacctggatttcgcaaacattaacttcgtgaaaagcgaggttctcagcatagaggataatatgtcaatttatggcgaggtggtggaatactatatcaatctcaagctgaaaaaagtgaaggtgttgggaaaataccccaagtacaggatcaattacagcaaagagattctcagtaatacgctgctgacacgagagctcaaagacgagtttaagaaatcaaataagggttttaacctgaaacggaagtttagaatttcccccgtggtgaataagatgggcaaagtgatactctatttgtcctgcagtgctgatttcagcaccaacaagaacatttacgaaatgttgaaagagggcttggaggttgaggggctggccgttaagagcgagtggagcaatatcagtggcaacctggtgatcgagagcgtactggaaaccaagatatccgagcccactagcctgggccaatccctgatagactactataagaataacaaccagggctatagggtgaaggatttcaccgatgaggatctgaatgccaacattgtcaacgtgagaggaaataagaagatctatatgtatattccgcacgcgttgaagccgataatcacccgggagtacctggccaagaacgatccagagttttctaaggagatcgagcagcttatcaagatgaatatgaactaccgatatgaaaccctcaagtcatttgtgaatgacatcggggtcattgaagagctgaacaacctgagcttcaaaaacaaatactacgaagatgtgaaactgctgggttactccagcggcaaaatagacgaacccgtcctgatgggggcaaaagggatcataaagaacaaaatgcagattttttccaatggattctacaaactccccgaaggcaaggtacgatttggcgttctgtacccaaaagaatttgatggcgtgtcaaggaaagctatccgcgccatttatgacttcagtaaggagggcaaataccacggcgaaagcaacaagtatatcgcggaacacctgataaacgtggagttcaatccaaaggagtgcatatttgagggatacgaactgggcgatatcaccgaatacaagaaggcggctctgaaacttaataactacaacaatgtcgacttcgtaatcgcaatagtcccgaacatgtccgacgaagagatagagaacagctacaatccgttcaagaaaatatgggccgaactgaatctgcccagccagatgattagcgtcaagacggccgaaatctttgccaatagcagggataacacggcgctttactacctgcataacatcgtcctcggtatcctgggtaagataggagggattccctgggtggttaaagacatgaagggcgacgtggattgcttcgttggactcgatgtcggcaccagggagaagggcatacattaccccgcctgcagcgttgtgtttgacaagtacggcaagcttattaactattacaagcctaacatcccgcagaacggagagaagattaacacagaaatacttcaggaaattttcgacaaggtgctcataagctatgaggaggagaatggagcctacccgaagaatatcgtgatccacagggacggctttagccgagaggaccttgactggtatgagaactacttcggtaagaaaaacataaagtttaacatcatcgaagtcaaaaagtcaactccgttgaaaatcgccagtataaacgagggaaatatcacgaatcctgaaaagggttcctacatcctgcgcggcaacaaagcctacatggtgaccacagatattaaggaaaacctgggaagcccaaagcccctgaagatagaaaagagctacggcgacatagacatgctcacagctctcagccaaatatacgcactcacgcaaatccatgtgggggcgaccaaaagcctgcgcctcccaatcaccaccggctacgccgacaagatttgcaaggcgatcgagttcatcccccaagggcgcgtggacaaccgccttttctttctgtagtaactcgaggttaacttgt

SEQ ID NO: 309 - DNA, 1973 bp, Artificial Sequence
  Description of Artificial Sequence: Synthetic polynucleotide
ggtgtcgtgaggatccatgccaaaaaagaagagaaaggtagaggatcccaagaagaaacgcaaggtggggtccggcagtatggaccgcgagatcattgaaaacttcaaccccagcgaccccaggaccgagggcgagaagtatctgatggataacttttcaacctcccccaggtttaatggctggacaatatttgagcagccccacatcaactcaatgaagcccgacttcatcttgctgcacccccacaagggcatcataatcatagaagtgaaggactggaacctcagcagcgagacatatgagaacggcggttacatctggggggaaaacggcgagaggattaagaaaaaccccatcaatcaagtagaaaactacaaaaactctatactcaagatggaacttacaaacagcatcgaatttagtgaagtgttcggcgacaaatacttcgcgtgcatagaaacggtggtatactttcacaaagccaacaaaattcaagccgagaacttctgcaggaggaacaataactacaccaagatctggaccaaggacgagttcgactacatatgcaatatcaataacaaactgaagggcagttgtcacacctatgccctgagctacgaaaaaagcacccttgaagacaacagaggtatgctgagtaaactggtggaggagctcaagtgcaatctccagtacagtgactacaactatgaacgacgccaaccgattaagttgacctatgagcaagagaagttggcgaggctgcaaaagaattcaatcaggaggtggagcggcgtggcaggcgctggcaagtccctgagtctggcgcaaaaagccgtgaacgccctgaaggaggaccatagcgttctgatcctgacctacaacataaccctgaggcactacctgcgcgatctgtgctctcaacagttcggacccggctcctacaaaggcgagcgcaagaagctgaggagcgacctgaccatctgtcactttcatgactttttgagaatcatcatggccgagtacgagatcgaggtcgaacatgacgaagacgacaacttcacccagcactggataaacaagatcgacagttgcataaaggtgaacggcatcaagagccacctcaagtacgactatatcctgatcgacgagggccaagactttgaaggcgaatggattaggttcctgaagcagttcttcaccgaggtgggtgagatctttatcgtgtacgacaaggcccaggatctctacgagcatggcgtgtggatcgaagacagcaaccaaatcaaaaacatcggctttaagggcaagcccgggaacctgaaaatcagtatgaggatgcctgagaagatggtgtacctggtgcaggacatcagaaatgagttcaagatagatgaggaggagatcaccccaaacgtgaacagccagcagagcttcatcgagataaccaagtggattaactgtatgcccctgacgctcactgaaaagctcgaccagattgaaatacaggtggactttctgcgccgaaacaacaacagcctggaggatatcacgatcattacgaccaacgaggagaccggagtggagatagtgaataggttcaaaagcaggggtatcaagaccagccacgtctacgatatggagaagcgggggaaccaggccaggcgaaggatggaaaaatggaaattccagggcggcaccggcagactgaagatttgtagctatcacagctataagggctgggagactccgaacatcatccttgtgctggacgagccgagcacaaagtatgaagacggcataattagtaagggggagtataacgagaagaacattttcgacgctatcttcattagcatgtccagggtgaaaaggaaagcccaaaccggtgagtttagctttacgtgcctgaattatcttagcgaatacaataagattgagggcctcttccactagtaactcgaggttaacttgt

SEQ ID NO: 310 - DNA, 2099 bp, Artificial Sequence
  Description of Artificial Sequence: Synthetic polynucleotide
ggtgtcgtgaggatccatgcctaagaaaaagcggaaagttgaagaccccaaaaagaaacgaaaagtcggaagcggctcactggggctgaataatgagtccaaagagttctttaagggcattagccgcatttggagaaattacaaggactacacctaccttgacgggattaagctgagccaggcgcagatcgatatcatcgagaaggaggaagaccaattgcttatagagggctacgccggcaccggtaagtccctgacccttatatacaagttcattaacgtgctggttcgggaagatgggaagagggtgctgtatgtgacttttaacgatacgctgatcgaggatacgaaaaaacgccttagttattgcaacgagtacaacgagaataaagagaggcaccacgtagagatttgcacattccatgagatcgccagtaatatcctgaaaaaaaagaagatcatagacaggggtattgagaaactgacggctaaaaagatagaagattacaaaggtgccgctctccgcagaattgcgggaatcctggctaggtacatcgaggggggaaagtattatagcgagttgcctaaagaggaacgcctctacaagacacatgacgagaactttatcagggaggaggtggcctggatcaaggccatgggctttatagaaaaggagaagtatttcgagaaagatcgcattgggaggtccaagagtatcaggctgacgcgctcacaacgcaaaactatattcaagatatttgaaaagtactgcgaagagcaagaaaacaaattcttcaaaagcctcgacttggaggattacgccctgaagctcatccagaacatagataatttcgatgaccttaagttcgactacatttttgtggacgaggtacaggatctcgatcccatgcaaattaaggcgctgtgtctgctgaccaatacgagcatcgtgctgtcaggcgacgcgaatcagcggatttacaagaaatctcccgtgaagtacgaggagctcggcctcagaatcaaagagaaggggaaacggaaaattctgaacaagaactatcggtccacgggtgagattgtcaagctcgcgaactcaatcaagttcttcgacgagtccatcaataagtataatgaaaagcagttcgtaaaatccggtgatcgcccgatcatccggaaggtgaacgacaaaaagggtgcggtgaagttcctgatcggcgagatcaaaaaaatccacgaagaggacccctacaaaacaatcgccatcatccaccgagagaaaaacgagcttatcggcttccaaaagtccgagttccgaaagtacctggaaggccagctgtacatggaaaaattcagtgacatcaagtcctttgagtcaaagtttgatttgagggaaaagaaccaggtgttctacaccaacggctacgatgtaaaggggctggaatttgatgtggtgttcatcataaacttcaacacggccaactacccactgagtaaagagctgaagaaaatcaaggacgaaaacgacggcaaggaaatgacgctcattaaagacgatgtgctcgagtttatcaatcgcgagaagaggctgctgtacgtagctatgaccagggccaaagaaaagctgtatctcgtggccgactgcaaaaacagcaacatcagcagcttcatctacgactttaacaccaagtactatgaggcacaaaatttcaagaagaaagagatagaggagaactacaaccggtacaagattaacatggagcgcgaatacggcatcatcattgaggacgacgactccaacaacgttaagaacaatgacacgaaacaagagaacaagtttaataccgaatctaaggaaaagggcaaagatgacatcgacaagataaaggtgtttttcatcaacaagggaatcgaggtggtggacaaccgagataagagcgggtgcttgtggatcgtcgccgggaaggaagcgatccctcttatgaagaagttcggtgtcctgggctataacttcatattcatcgcaaacggcggtcgggcatctaagaaccggccagcctggtacctcaagaatagctagtaactcgaggttaacttgt

SEQ ID NO: 311 - DNA, 3227 bp, Artificial Sequence
  Description of Artificial Sequence: Synthetic polynucleotide
ggtgtcgtgaggatccatgcctaagaagaagcggaaggtggaagacccgaagaaaaaacgaaaggtgggctccggaagcatgaacaacaccataaacaaaatagacttcggcgcgtttctgagatcattcaagcagaacctggacggtagcttttctttccttctgggagcaggcgcgagtgtgagcagcggcgtacagtctgcaagcgactgcatttgggactggaaaaaagacatttttctggcccaaaaccttcaatttgaggagtttctggacatccatagtgacttctgtaaagataaaatccaaaagtggttggatgagcagggcgtgtttcccaagcgagactcagaggaagagtacgtgttttatgccgagaaagcgtacccaatggaacaggacaggaccaagtatttcgagaacctttgcgcggacaaaaccccctacatagggtataaactgctgatgctgctgaacaaatacggagttctgaaatccgtgtggacaacgaattttgacggtctgatagaacgcgcagcgcaccaagccgatctgacgcccatcgccgttaccctcgacaaccccgaaaggattagccgaaacgagagtaaatctgagctgctctacgtggcactccacggtgactacaagtatagcaagctgaagaacacagcccaagagctggacgcgcaagaaattctcttcaccgaacgcctgaagtcttacttcatcgataagaatttggtggtgatcggttacagcggtcgagacaaaagtttgatgcacaccttgtgcgaggcttttatgacgaaggggtgcggtcggctttactggtgcggctacggtaacaagattacctctgaagtgcagaacttcctcaacagaataaacgattcaggtagggaagccgtgtacgtggacaccgatgggttcgatgccaccctcgtgtctattatgaagttttgctacgaggatcaattcgacaagaaaatcgaaatcggcaagtatctcaagggcctgtcaagggtgaagcatattatccctttcagcgttgagaataccacgttcaccggctgcgccaagaccaacctgtaccccttgatcatcccccaagacatattccagttcgagatagagagccccgaaggtagcagcaaatggaccttcattaaagagaagattaagggcaaggacattatcgctgccccttacgagaaaatagtctacgcatacgggctgccaaactcaatctacaacgtattcagtaaggagctgatcggcgagatcaagagggttcccatcagcctgagtaacatcaaagacaacagcaccctcaagaatatcatcctgaaggtgctgatatgttctctgagcagtaacgcgggactcagggcgagtatgagcaagaagatcatctggaatgagaaagagaggttccagagcaacgtttttaaggcaataaagatcgacatcgttttcatcaatagcgaaaagtacgccctcatctcaatcacccctaccctctatttcaacaaggagggcaactacacgacgctgcagaagcaggaaattacgcggagctacattgacaagctgtacaataagatttatgaggaaaccctttgttactgggaggccatcctgtttaagcagcagaccaagatctgcttcgactacccgctcaattccgggaacggctgtttcttcaaggttagctctaacaggggcgaagccctgttcaataatccgaataagccgtacgtgattactaacgacatcatacttaaacgcaaaatctacgaaggcatcataatcgacgagcccctcctgaacttctcagggtcaaccagcgcccacatcattatggactccaatccgatgcgcggtctcaacaacaataacccatatgatcacttcattgcaagcaagtttagggacgtttctatccacatcggagtcgtgtgtccctgtacatatagcgacaggttttttagctttctgaacgagctgcaaagtccgataaagaataacaatcctaactcagactacatccagaactataacggattcagccagatatacgcaagcattcttaatatcccagcgatcaacagccaatactggatctcatgccgcgaagagcaggataacagcatctctttggctaggaacctgtgtaaatacgcgaaccagatggccactaacatgccaggtataatagttaccttcttcattcctaacagctggagcaaccacaagagtttcaaagaatgtggcgaggtattcgacctccacagttacatcaaggctttcgccgcacagcacggttttacaacccaaatcattgaagagcgaactctcacaaatctctccatgaaaaaggagatctattggtggctgagcctggcgttctttgtaaaggctatgcgagtaccatggaccctggccaatctggaccagaacaccgccttcgccggcatcggctactccctgagcaaaaagcaaagcggcaaattcaatatcgttatcggctgtagccatatctataattctgagggccaaggcctgaggtacaagctctcaaagatagataatccaatcttggaccggaaaaacaacccgtacctgacctataatgaggcgtataagttgggcgtgaacatacagaatctgttcattcagagcatggacaaactcccgaagcgagtagtgatccacaaaaggatcccgttcctggaggacgagataaagggcattaccgaggcgttggcccaggccaacatcacgaatgttgacctcatcactatcacgatcgaaaagaacatcagatgcctggatcagttcttctacaatggtcaagccaagaacagcaacttcccactgcataggggcacctgcatgaagctcagtgataccgagtgtctgttgtggacccacggcgtggtggactcaattaaggcgggcaggaactactactctggtggcaagggtatcccctcccccctccgcatatcaaagttttacggcgcaggctctatgaagactatatgcaacgaaatcctggggttcacaaagatgaattggaatagctttaacttctataccaagcttcccgcgaccatcgacaccagcaacacgctggcgcaagtggggaacatgctcgataattacaacggtattacatacgattacaggtatttcatctagtaactcgaggttaacttgt

SEQ ID NO: 312 - DNA, 3002 bp, Artificial Sequence
  Description of Artificial Sequence: Synthetic polynucleotide
ggtgtcgtgaggatccatgcctaagaagaagcgaaaagttgaagaccccaaaaaaaagcgcaaggtcgggagcggatctatgatgggagccagcgatgagtattccttttacgctgaaaaggcctatcccatagaagcggacaggcaaaagtacttcgaacagctggcgtacaacaaagccccctacattggctataaactcttgtgtctgctgaataacgcggggctgataaagtctgtttggaccacaaattttgatggcctgacggaaagggccgctcaccaaatgaacatcacccccatctgcattaccctggacgaccccgagaggatttttaggaatgagaactctcacgaactgctgtatatcgcccttcacggcgattacaaatatagcaagctcaaaaataccacccacgagctggacacccaaaacaatatcttcagagacgcactgaagcgatacttcgtggataagaatcttattgtcataggatacagcggccgagataaaagcctgatgaacgcacttaaagaggcattttcccaatccggctccgggcgactgtactggtgtggcttcggggacgatatatgcagcgacgttaaggaattgatagacatcgccaggagcaataatcggattgcctacttcatcccgacggacggcttcgataagaccatgctccaacttagtcgcgcctgtttcgaggacgacattgtgaagcaggaggaaatcaaaaagctgatcaagtccacgatcaagaaggacgagacgaagaccagcttccgaatcgagagcagcaggaacgataaacttattaagtctaacctgcatcccgtggcgttccccaaggacgtgtaccagttcgagattaagactaacggcgagcatctgtggaacaacatagaccagatcattggcggcaataaggacatagttgccgtaccgttcaaaggtaaggtgttcgctgtctcaagcattgcgaaaatcaaggagaggttcgggggctatatcaagggggaaatattgaaagacccgattggcgtcgatgacatccgcaaagtatctgtgttccagcggcttatgatgaagagcatcctgattggaatctctgagttggcaaatctggaaactgatggaaagtggcgcctttggaaaaagaacaccctgaggcgaatcgtaaacggcacggagtatttcatcgccgacgctgtagagctgtcctttttcttcggaaaagataccaagtttgcctatctcagcatcaaaccgaccatttacatttatacacatagcgacgaattcataccgaaggatataaagctgcaattcacaaaggagaagttcgaccgactctataatgcacaatacgaccaatccctggaggagtggaataatctcatcttccacaacaacagcctgaggttcacctttcccgtactgaccacctccgacatgagctttagcatcagcaacaatgtggccttctcaggaattaaggttttgagtgacaagtataagagctaccccgtttctatcgagcagaagcgcatagttttcaagggcgtggagttcctggagccccagctgctgtttcaaaataagaacagcaacttcaagtcacgcgacttccatcccatgaggggattgattaaccactaccccttcgactaccagaacaatgggatcaccaacacgtttaatgtcaaactcggcgtgttgtgctcctctaagtactctactaggctgtacgagtttctcatgaaattgaatgcccaacataaagcgcccgagaaaaacgagtacataattgactatgctggattcaaccaaatctacaacatccctattgagataccgctggtaaacgacgagaagtggatggacgtaaagtttaatagcagcgtgagtatcaaagacgacgctctcaacctggcaagaatcatatgcacccagatcgaggcgcttcacgagtcttacaaaactgacatgaccatcgtgatcttcattcccaacgagtggcaaccctacagacatatcgaggaggacacatgggtttttgacctccacgactacatcaaagcatatagcgctcagaaaagaatttccacgcagttcatagaggaagatactctgaacgattcattgacgtgccagatatattggtggctcagccttagtttttacgtgaaatccttgcggacgccgtgggttctgaatgctaacaataatgagaccgcttacgcgggcatcggctacagtataaagaataacaacggtgaggcgtcaattgtcctcgggtgtagccatatttacgacagccacggccagggcctcaagtacaaattgagcagagtgcaggactgctacatcgacaacaagcggaacccctacctgagctacaatgaggcctacaactttggcataagtatcagggagctctttctgcacagcatggagtacctgccaaaaagggtagtagtgcataaacgcaccgagttcaaacccgacgaagtgaatggcattgtcgactcactgcagatagcgggtatcgagaatatagaccttatctccatcaacttcgagcgggaagttaaattcatgtccactaaatccaactacgggcagttgcaaatcgataactttcccatacgcaggggcacctgtatcgtggtgaacgactatgaagcccttctctggacccatggaattgtgccgagcgttaagtccgataacaggaccttctatctgggcggacgatctattcctagccctcttatcattaagaagcattacggtaagagcgatatcaacgttatcgctacagagatactgggtcttaccaagatgaattggaactcttttgatctctacacgaagctgccggccaccatcgatagctctaatcaaatcgcgcggatcgggaacctgctgactaggttcgagggcaagacctatgattaccggtttttcatttagtaactcgaggttaacttgt

SEQ ID NO: 313 - DNA, 2567 bp, Artificial Sequence
  Description of Artificial Sequence: Synthetic polynucleotide
ggtgtcgtgaggatccatgcccaaaaagaaacggaaggtggaggacccgaagaaaaagcgcaaagtaggtagcggcagtatgcgattggggcacataggcaacggctgttacagggaaggcgttaaagcacaattccagacacgagagagggaggatgccggttcaagggctgcggctgcccaacccccgattaagcaattcggatacaccgatagactcggcctgaacctcgcccccataaggttttctagcgaagagtttgaagccggacggacggtgtaccgcgacgaggaacagtaccgagctcttagggaagcccatcaagccacccatgcctttaggtatgacgcaagggacgcggctatatacgacatccctatggcagaaggggtggcgcctctgggtactcccgtgaggatcaaaactaaggaccacctcgctctgctcggcaaagcggctaaccacgcgctgctcgattggctcgcaccacgcagaaccattctgcggagggcgagacctcttcagtgctggggcaacaggaaggcctcactgttgtcagccgccgtgcgggatcaaggacttgccgaaacaaagggtctggatgttctggtaaggcattcttttgatttgagggctttgggcgcacctcaccagggtgctgaaccgtaccttgccctgatgttggacgtgagtacgagcaatgagctggagatacctgtgggcgagcttctgcgcgagagattcgaccccatcggtcgatacgtttgtgccagagccgactctggccaagataacgtacttgctaggttggaaacactgggtagggtcgtgggtgtggatggtggtaagcttcaactgaacgactttaccggagaagaattcgtggacgctgattcagtcacgttggagcctagattggagaatctcgatgcgctcattcgccacttctatcccagggatgcgccaaaaatcctggagggccttcgcaaaaggagagtgcctttctccaccgcgaacgacaagctggcgaagatacgagaagtgcacggaggagtagccggccaccttgaaacgattaggatcgctggcatggctatagaggtgggtgccctgctgcagagaggctctaacctgtttcccccactcataagcacggaccggcctggatttctgttcggcgctcaaggtagggaaactggcgcgttccccgacgtgggggtgaagcagcatgggccctacaagtacatgcaacacgagcgcaatgaacctgtgatcgccatcatctgcgagagcaggtttcggggtcggatagaccaactcgcccgaacacttcgcgatggtgtcgcggaagatgcctggcaagacgcgatgaggggcagaaataaggtgccggaaaacccctttagaggcgggctgatcggtaaattgagattgtctcgggtgcagtttgagttcgaagaagtaaccgagcccactcccgaagcctatcgcgaggccatccttcggctgcttgcgagactcccagagacacccgacctcgcgttggttcaaatacgagcggattttaagcagctccgcaacgacaggaacccatacttcgctgcaaaggccgcattcatgacggtgggagtgcccgtgcagtccgtacaagccgagactgcggacatgcagcccagtaatttggcctacatggccaacaacctggccctcgccgcctacgcaaaattgggcggtagtccgttcgtgatctccacacgcatgccggcgacgcatgagctcgtggttggcttgggctacacagaggtgtcagaaggacgctttggaccgaagtcccgatttgtaggcatcaccaccgtgttccaaggcgatggcaggtacttggtgtgggggcaaactagagaagtagaatttgaaaactacgccgacgctctcttggcgagtctgaagactaccatcgacacagtgcgcaaggacaataactggcagccacgcgatcgagtgaggttggtattccacgtgtataagccccttaaacatgtcgagatcgacgctatcaaacagttggtgcaggagttgctgaagggcgaacatgaagtggagttcgcatttctggacatctcccgcttccacgattttgcccttttcgatccttcccaagagggcgtgaattactacgctgaccgcagacgactgctgaaaggcgtgggcgtcccccttaggggtatctgcctccaactggacgaaaggagcgtgctcttgcagctgacaggcgctaaggaggtgaagaccagtgaacaaggtctgcccaggcccctgcgactgacgttgcattccgagagtgattttagggacctcacatacttggcgcgacaggtgtacagctttagctacctctcctggcgcagctacttcccggccatagagccggtgagcattacctacagcagacttattgccaatgcacttggcaaccttaagagcatcccgaactggaacagcacattcttgacagctggcccactgaggtcaaggatgtggtttctgtagtaactcgaggttaacttgt

SEQ ID NO: 314 - DNA, 2126 bp, Artificial Sequence
  Description of Artificial Sequence: Synthetic polynucleotide
ggtgtcgtgaggatccatgccgaagaagaaaaggaaagtggaggaccccaagaaaaagcgcaaggttggcagcgggtccctggagaacctcaccataaacataatccccttcaagcaccccagcatccaaaaagaatttggcttctataccgagaagaaggagggctatttccccattcataggaccgagttgcccaacgagctgtgggacaaccagaaagaggaagtggtgaagcacaagttctactacacgaactttgaagacacggaggattgcgttctgaagaccaaggtggacctgtatagtagcactaagtttgccaagcatctgtacacgcgattggtgtaccagtatttcattgggatagcggatgcaatccagttcaactacgtgggtgacatagaggtttggctgctggatgcgaaagccagcaccaccaaatacaatagctacaacaagtataccctgaaaatagagtttagcggtctgaccaagagccccgctctcctcctcagctatgacaacactagtaaggtagcgactacgagcatagacgaaatcaacattcccaccgagtacttcaagaccgtcgtgtataacaaagaaatccagaggttcaagtacctgaccgaggacgcgaaacaacacctcgatcaagtgtatcccctgctcaacataccgttgaaaaaccatcttgagattcctcacaccgttccccgcaagggcaacaggtataagccctactttaaccacattacgactttttacaataactatttgaacaccgacgaattcagggccatcctgccccttgatgagaatggattcttcaatatcccagaggacagcattttgaaaactagcaaaaattctaacaacctccggttctataagaaagtcggagtagatcccaaggctggaatgaagaagcccggtccctacaaggcctccccccacgacaacgtgaacctgttctttatctatcacaaacccgacgcacatgaatacgccaaaacgttgcatgactacttcatggaggggtacaaaaagttctttccccccctcaagaacgttatccggcagccgctgttcctggacaaaggcacctcacttgcatttgagagcttcgacagctgcatcgccgagctgaaaacccatctgttcgacctcaaaaaaaagcccaatacccggtacgtggccatctacgtgagccccatccataaggaggacgaagacaataaacacctgtactaccaggtcaaagaagagctgcttaaacatgacatcaccagccaggtgatttacaaagagtccatcaaagataaatacttcggcgctttcctcgagaatatcgcaccagctttgcttgcaaagatcgacggcattccctggcgactggacagggagttgaaacaggaactgatcgtaggcgtcggcgcctataaaagcagcgtcaccaacacaaggttcgttggaagcgccttttgctttaacaacaaaggagagttcaagagctttgactgcttcagggagaaggaattcgatctgattgccgggaaaatcggcaagcaggtgctcaccttcattgaggagaacgagaacaagttggagaggctgatcatccattatttcaagcctttcaacaaggatgagatagatctcgtgcaggagaccctcggcctgctgaagctggaaatccccatcatcatcgtgactatcaataagaccgagagctccgattacgtcgcttttgacaccaacgacgacgccctgatgcccctgagcggcaccattatcgagatagcacatctgaagtatctgctgttcaataacgcgaagtacagcagcatcggcttcgccaaagaccaccccttccccgttaagctcagtctgtactgcaccgaccaggattacttcgaggacatcgccatcgtcaaggagctcatagatcaggtttatcagttttctaggatgtactggaagagcgtcaagcagcaaaacctgcccgtgacaatcaaataccccgagatggtggcccaaatcttcccacactttgagggcgataaactgcctgattttggaaaaaacaatctctggtttctgtagtaactcgaggttaacttgt

SEQ ID NO: 315 - DNA, 1424 bp, Artificial Sequence
  Description of Artificial Sequence: Synthetic polynucleotide
ggtgtcgtgaggatccatgcccaagaaaaagaggaaggttgaggaccccaaaaagaagcgcaaagtaggtagcggctccatgctgaccaataatcagattgtgctggagcaggaacttctgggaagcatattcaaaaacaataacctgatgctgaaagcccgagagaagataaaaccggagatgttcctgtatagcaaacacatgaacatttacctgggcatcctcgacatggtggccaacaagctggaggtggacctgatcacctttctcgagcaccataagaaaagggtgggggatatggatggcgtaacttacgtgaccgagatctacacctgcagcgcgtccgacattggcttcaatacaaaacttgacatgctggtgaacaactacaaacggcatctgtatgtggagatgaaggacaaaatcaacagtgatatgagtcttgaggagatcgagagcgaggttgaaggggtgaaggtaaaggtgcacaaatgcaacatcaagaaagaactggatatagacaagcaatatgacgattacatcaactggctttacgacgaaaacagagacaaggggatgaaaagcggcctgacctatctggacaagtatctcggcaacttccagaagggcaggctcgtcaccgtgttcgccaggagcggcgtcggcaagaccacgttcagcttgcagctggccgccaatatggctctgaagggccacaagatattctacgggagcgcagagatgacccgcaaccaggtctttaacaggatcgtggcctcaggtttgagccttagcgcgaaggcgattgatgaggacaccatcctgaaggaggacaaggagagcatcgccaagtttatgaccaaggttatcaacaacaagttctacgtgtcaaccgagaccgacttcgaaaagttcatcgacgagataaaggtttataagctgcagaacagtctggacgtggtgttcgtggactacattaacaagtacatcgacttcaccgacagggacatgttgaccaacaaactggggaagatcagcggcatgctcaagagcctggccatggaagaggatatctgcgtggtgctgatggcccaggccaatagagtgattgacaagaaggtgggtgacaatgccgtcgaaaaaatcgacagcagcgacatccaggacagcgccagaatcgagcaagacagcgaccaagtgatcggcctgtaccggaacgtgaagctcgatgataaaatgtatagggagaacctgttcaatcagggcaagctcaagtataattccaagaacgccgacgacaatccggaatgcatgaacgctgtgatcattaagaacaggcatggcgaccgaggcacgtgtgcactgaggtggcacggcaggtacagcagggtcagcgacttctagtaactcgaggttaacttgt

SEQ ID NO: 316 - DNA, 2369 bp, Artificial Sequence
  Description of Artificial Sequence: Synthetic polynucleotide
ggtgtcgtgaggatccatgcctaagaagaagaggaaggtcgaagatcccaaaaagaaacgaaaggttggatcagggtctcttcaccttaactacctcccattgcgctttaccgccgatatattcaagggtggtgctttgacatttcccgaaggcagcgagaaaaactggaccagcgacgatccaatcagcaaggagctgagcaagttgcgagagaaacacggagatagtcatgtcttccaccggatgggaaacaaaattgcatgtatccccgttgtggagaacgccattgctataggcaccgagacggatttcaacatcattagtgactttcagctggctaatgctcttgctcgcagcgccctccacaggtacttcaaagctgcgggaagggagactgtaattgggttccgacccgtaacccttctcttggaaaaacacaacttggccagcaacaggaaggacgtgttcggcattttccccgagtacactctggacgtcaggcctcttgcaccacatgagggcgacatagcgagcggagtgcttatcggctttggaataaagtatgttttccttcagaacgtagccgagctgcaggcacaaggggtgagtgccgcagggatgtacgccgtgaggctggtagacgagagcgaacatcaatttgaccgggcctacctgggaaggattgatcggttcacaaaagataacgtgacgctcgttgacagcgattacgcggaatatcccgccgaccagtgttacttcgagggaagcaggaccaacatcgaagccgtgggccgaagtctcctggggaaagactatgatgccttcagctcaagccttttgcaggagagctacaaagtgaccggagcccccaaccaaacccaacgactgcaccagttgggcgcgtggctcgaggccaagagtccgatcccctgcgccgttggtctgggagtacggattgcaaaaaagccgcatgagtgctcacgaggcaacgacgccgggtacagccgctttttcgacagccccaagtgcgtgctgcggcctggcggctctctgaccgtgccctggccggtcgacaagcagatagatctcaatggcccttacgacgctgagagctttcccaacaagagggtacgaattgccgtcatctgccctcaggaattcaccggggatgcggaagagttcctccggaagttgaaggagggccttcctaacgcaccggacggcagtccgtttcgcaagggctttgttcgaaagtaccatttgtctagctgtgacttcacgttccatgaggttaagcggagctcaaacagtgacgacatctacaaggatgcgtcccttgaggcactgaagcagaagccagatatggcaatcgccataatccggtcccaatatcgcgggctgcccgatgcttctaatccctattacacgacaaaagctaggctgatggcccagggcgtaccagttcaactgctgaacatagagaccatcaggaggaagtctttggactacattctgaataacatcggtcttgcgatgtatgccaaacttggaggaatcccttggaccctcacccagaatagcgacatggcgcacgagatcatcgtcgggatagggtcagcccggctcaatgagagcaggaggggtgctggcgagagggtcatcgggatcacgaccgtgttcagtggtgacggacagtacctcctcgccaacaacacccaggaagttcccagcgaagagtacgtagacgcattgactcagtctcttagcgagacagtatcagagcttaggagccggttcggttggcgccctaaagatcgagtgaggttcatattccaccagaagtttaagaagtacaaagacgcagaggcggaggcggttgataggtttgcacgctcactgaaagattttgacgtgcaatacgccttcgtgcatgtgtctgattctcataactggatgctgctggacccagctagtcggggggtgaaattcggcgatacgatgaagggcgtcgccgtccctcagcggggacaatgtgtgcccctggggccaaacgctgcgctgcttactttgagcggtccgttccaggtaaagaccccactgcaaggctgtccgcaccccgtgctggtgtcaattcatgagaagagcacttttaagtctgttgattacatagcccgccaaatcttcaatctcagcttcatcagttggaggggctttaaccctagcaccctcccagtgtccatttcctactccgacatgatcgtagacctcttgggacatcttagacgcgttaagaattggaatccggaaaccctgtctaccgctcttaaggaacgaaggtggtttctgtagtaactcgaggttaacttgt

SEQ ID NO: 317 - DNA, 2390 bp, Artificial Sequence
  Description of Artificial Sequence: Synthetic polynucleotide
ggtgtcgtgaggatccatgcccaaaaagaaacgcaaggtcgaggaccctaagaagaagaggaaagtagggtctggctctatgcaactgaactatttccccatccagtttgacttttctgactaccaggtcatcacgcagccctactccgacgagagattgaaagaactcaggcaggcctacaacgccagctattccttctttcgggacggcaaccttatcgtaatttccaataaagaggacgaggaaaaccaattgacgggcaacgtcgaaaaccgcagcgtgttcgacgatgccaaagttaccgccagcatggtcaagcatatattctttaggacgttcaaggacaggttccaaggcttcatccccgtggacttttaccccttccgattctacagcagacaagagaaggacgaccttattctgaaccacctgcccgaaaaacttaagcataaaatcgcctttaagaaactgatcgaggtgcagctcagggagacgaatcttaattcaacccagggctttgctttcgtcgtcaacatcaggagaaattgggtgtttaacatttcctgtctcgagctttatcaggaaggctttgacctcacagattttgaagtgctccatgcggagacgcttcccgggttggacaatatcctggccccgaacgaggacttcgttggccttctcaagagcatcaacggcgagactgccattgtgagcactagcgagggtgcccgctcctattcactgcaggagctcttcattcgcaagactaagcacaacatacaggcgtacctcaacttcgccaccggggaaaaaaagtgcgaccagatccttgcagccgtgtcccaggaacgaatccggaagcagaaccccgtgaatcaattcagcgagatatccaacatcgcgaagcatcttttttcagacaaaggcaatccagtgctgttccagaatatggatggcttttgttttaaagttgacaccacgccgatgcaggtacaaaactccatgaacctgcaaactcccacgttcatctacgaccacgcgggtaccaagacgaacacccgcaacgcggaccaggggctgagctactacggcccctacgatagcctcaccttcgacattaagaagccaagagttctctctatctgccataagaccaaccgaggctcctttacgcgcttcctccacgacctcaaagacgggctccccaatagcagctggttcaagaagggcctcctgaagaagtacgagcttcaagaggtgaattacctcatccaggagatcagcgactacaggttggaggactacctggaagtgatctcaaactacgatgatgagaagccgcacctggcaatcatcgaaattccagataggttcaaaaaactgtccgaccgggacaacccctatttcaagattaaggcaaagctgctgagccttgagattcccgtacaatttgtgcgcagcacgactttgagcagctacagcgaatacatacttaatccgcttgcattgcaaatctatgcgaaactcggcggcacgccttgggttcttccggcccaacgctccgttgaccgcgaaatcgttattggcataggtcactcatggcttcggagtggcatgtataagggtgctgaaaacagcagggtggtcggcattactacgtttatgtctagcgatggccaatacctcctgggcgacaaggtgaaagacgtgccttacgagtcttacttcgaggagttgctgaagagtctcaaaagtagcataagcagactctccgatgagtatgcctggcaggatggcgacacagtgcgcctcattttccacatcttcaaacccatcaagaacgttgagttcgatgtcattagccagcttgtgaaggacatcagccagttcaacataaagttcgcgtttgtgaccattagcaagtcacacccgtctattctctttgacacgagtcagcaaggcgagaaaaagtacggctctaaccaggtgatagggcagtacatccctcagaggggtagcaatatcttcatagatgacgaaaccagcctggtgcagatgctgggcgccagggaacttaaaactgccaaacacgggatgagcaccccaatccaaatcaaacttaggacaccgcagggtaaccataacgaccaagaactgaaggatttgatgttttacgatcttaactacattacccagcagatctatagttttacttacttgagctggaggagctttttgccacgcgaggaaccggccacaatgctctactccaacttgatatcccgacttcttgggaagatgaggagcatccctgaatgggatgcggataagctcaattatacccttaaaaggaagaaatggttcctgtagtaactcgaggttaacttgt

SEQ ID NO: 318 - DNA, 2408 bp, Artificial Sequence
  Description of Artificial Sequence: Synthetic polynucleotide
ggtgtcgtgaggatccatgcccaagaaaaaaagaaaggtggaagaccctaagaagaagcgcaaagtgggatccggctctatgttggagacgaatatcagggtggtgcggcctggtccgcagctgtgcgttcctgtacgcagggtgatcgtgtccggtcaaaccttggctcccgacctcctggagaggctgtgtaacctgctgcgaaggaggtacggcattagcgccgcaagaataccgggctccgtgagcgagctgttcgttgcgaccgaccggcaggtggagaaggtgacactggaagaagataactggcaactgaccgccgtggactccaacgaccctactcgaatcatgtccatctctaacacggacgatgagagctttataagcatcctgatcgaacgcgcgctccttgcccagatcgccagtcgaagcctcttttggaccctcgactctcctcgaatttggtatgagaagaacccgttccaaaggaatgaaggcgtagccgtctaccacaggtacgaggtggatgcgctccccctcggcgacgcaggcattggcatctcagtggatgtttcaacggccttttttagcgagcacaccctggagtactacttcgcccccaacctgattagcggcgagagcaagacgcgacaggacgaattccacaagttcaccggccgacaagctggtcaaaaggggacgctgctttacaataacggcaggagtaaggtgaagtgctatttcgagaacaatagggtgggcctgacatgtggcgcaaccggccaaatgaaactcgagggaatcacgtatcccagcctgtaccactactatgcgagcaagtatagcgcattgcagatcaacgagaacgatgccgcagtgcaagtgtctttccctggcttggaccgcccagttccggtagccgccaggctcctgtccctccgagtgatgaacgacgacgtgcccgatggtctgagctccgtcgacaagatccctccaaggaaccgcaagtaccttatcgagcagttttggaagtgcctggagccgagacccttcgggaatgtggcccctggtgtcttcgacggcttctggagacccaacaacgaaagggtgcattacatccagctgcccgagattaactttggacaaggccaaaaagcagaaccgcctgacgtacgctccgttgcatccatcaaaaactattttaggcgacgactggaattgctgggtcacgcggggtgttaccactttccgccctcagcccccaggacaatcttctgcgcctacccgcagtcattgggtgaggagatcccggaaaagttggtgaacgggatcgtcaatgtgctgaacaagtggaccggcctcagcttctgtagcaacctggtaagctacagcacggccagcgaggcgtacggtaaattgaggagggccgagagtgccggcgtggtcctgttcatcttggacgaggagccggcagtctactacgacgcgagcttcaatcttgagggctggagggtaaagcgcgtaaccgagcctgtgctgcgccagcagcataagtatctgaccaacggcgtgtgggaccggaagaggcaagagtatagtttggggagggggcagagtcgctgggaaagcttcatcaatttgatcggattggacgttatccagcaactcgatgccattccgtataggatccccaacatcggcccctacgaaggccagctgataatcgacgtggggcatgacaggcaattcttcgccgtgtcactgcttattgtgagatcagaagacaaagtgcccgcatttaacatcagcagccaggtccagcacaaggcggatcataagcacgaaagcattaacccggtgctgttgaaggacaccatcattaacgtgttcaagaccgccaaacggaggacttttgatcctctgactagcctgttgatcatgcgggatggcaacgtgcagggcagcgagatcggcgggatagacaacgccctggtcgaacttaggcaacttggcataatctcccccgatgcgaggctggacatcgtgggcgtacacaaggaatctgtaagctccatcaggctctgggacgttgacgtaaggggggaggtaagcaacccgatcgagggcaccggtctgtcagtcaactcatctctgtacctggtggcgtgcacaggtgaggccacgctgacccaaggcaccgcagagcccgtggccatcgtcgcaaacaacaggtgcctgagtattgccgatgcagccctgagcgcctttctggcagcccaactgaactggagcagcccgggagtcgcccagcgcctgcccctgcctctgaaaagaacagatgaggaacttaccgctaggagcgatcaagaaattaggaggataaggtagtaactcgaggttaacttgt

SEQ ID NO: 319 - DNA, 2156 bp, Artificial Sequence
  Description of Artificial Sequence: Synthetic polynucleotide
ggtgtcgtgaggatccatgcccaagaagaagagaaaggtggaggacccgaagaaaaaacgaaaggttggcagcggcagcgtgcagcagacagtggagctcaccctctacacagaaaaacatcccgacacccacccagagctcgtttatgccgacgagtgtcccgacctgtggcaacagcacagcgagcttacgggggacaaatctctgttctactctcttacgaacccggcagaatgcaagggaacccagtacacagtgcaaatcaacctgaataaccagaagcagcgaaggatcgccaagcacataattagccagcaactgtataatcacttccgccagacccaaatcgctaccttcgacaagatcgacaatgtggaggtgtggaccaagaacacccaacagcctacccagaattgcacggagtacctgaggttcagccttataccccaatacgccgtgttctctgactcatgggagctggtcgtgtcctcaaatggcatatccaccgtgtataacaagcctttgagcgcactggaccttcagaccgaccgattcaaggtcgtcgttggaggggaagtggtcaagtacaagaacctgagccccaatcaaaagcaacaaatagacgaggccttccccaaaatcaatagggaactggccgctgaactgcatattaacgagaaacgctttctcaataaagacaagtatacgaccacctacaaccacattaacaacttcgtgcgacagcaccttctcacatccgagttccaggcactgttttgtctgagcggcgagatgttcaacgtacccgaggagcggatcggccaagtggcgaagggggcgaacctgttgcagtttaaggacggcaagaccggcattgacccattcagctgtgtgttcggcagcaagagcatggacgcactcggcatctaccaacccagcctgaagccccaggtgaaattctttttcatcgcccagcaaagcgatatcaacgtgtgcaaaagcctgtacgatattttcacgaagggatacaagccctacgtggacacagccactggcgagcagaggtacgtgttcccacccctggcgacgtgcatcaagcagcccttttcaaccgaccccaaggggagcatttacttcagcgaccctcaaaatgccctgagcgagatcaagagccagcttaacaataagcctcttgacccccaaacgcagtatgtgagcatatacgtgtcacccatccctcgcgacgccgtcaacaatccctactacggtctgtactttcagattaaggagctgctgctcgaaaagaggataacgtctcaggtgatctataaggaccgccccaacaaccagtacttcaacttccatctgcccaatatcgcgactgccatcctggcaaaaataggcggcatcccgtggcagttgaactcccacacgacgaacaaagatctggtgataggcgtgggcgccttccttagcgaaaaagttggcgagaggtatgtgggcagcgcgttcagctttaaccccaacggcctgtttaagaacttcgactgctgtaaagcgaacgatctcgaatctatcgtagccgggatcagaaaggccatcggacacttcgttgtggacagcgaaacaaacccccagaggctgatcatccactactacaagaccatgtcaaagagggaggccaggcccatcacgcagatgctgaacacgcttggcctcaacattcctgtattgatcgtcacaataaacaagacggagaccagcgacattgttatgtttgatgagaaacagcagggctacatgcccctttcaggcaccgtactgaagataaggaacgatgatttcctgctctacaacaatagcaggtacaaagagaacgaaaagtcagatatgctttttccagtgaggatccgcctgagtaagatcgtaaaccaatccgacaaagacatcccaatgacagacgccttcaatttgctcaaccaagtgtaccagttctcacgcatgtattggaagagcgttaagcagcaaaacctgccgatcacgataaagtatccagagatggtggccgagatagtgccacacttttcagaagccgaattgccgcagttcggaaagaataatctgtggtttctgtagtaactcgaggttaacttgt

SEQ ID NO: 320 - DNA, 3110 bp, Artificial Sequence
  Description of Artificial Sequence: Synthetic polynucleotide
ggtgtcgtgaggatccatgaaaattatagataaggaaaccttcatcagaagttttaaagttttgagcaatcaatcctttgacctgttcctgggcgctggcgcctccatatctagcggtatcccttccggaggcgacctcgtctggcattttaagcgcgaaatactgaattccaacgggaagataaatattaaaaaatttcaagatcttaagatagaagataataagaaggttatacaaagtttctttgaggagactgaggagaacaacattattaatccttattcctattattttaacaaatgttatccagaccccttgataagaaaagaattcttgacgaatcttgtgagggacaagaagccttccataggatttatgtgcctgtctgctctcgtggagcagcaaaaaatcaacacagtatggacaactaacttcgatgacttgattgagaaggcgattaacggattgaattacaagtcctgtcaaattgtctcacccgagaatgcgggcagcgtgaataactttcgaactgatatccccactgttgttaagcttcacggagattttaggtatgacccactgcagaatactgacgaagagttgcagaaactcgaagagtccttgcataagtatttcgtagaggcaagcacaaagaggggacttctcgtaatgggctattctgggtcagatgagtctgtgctgcaaagccttgagaaggcgctggaagagaacaacgcgttccctaagggactcatttggtgcatccccaaaagtgtcaccccaaaccaacgactggtccgaattatatctaaggctaatgagcagaaccagcggtccggatttatgattatcgacagtttcgattatttcttgcatgaactctacaaaatatgcgaccttacgaatgactatatcgactctattaccaaggagagatttgaaaaaaggcagtcatttaggcttaaccaaactccgtcctctactctgccaatcttgctgaacgcaataaaagcaaagcacttcccgaaaagtacctttctgactaaaacgaatatctcaggcataggtaagtggaaacgcttgcgagacgctataggaaatagctctatagtcggatctttcggtaagaacgattctctcagactttttggaagtgaacaagacattaataatgtacttaagaactacttgattgatgatttgaagatcagtgatatcccagagcacctttttttccattctgattcattctacattggcatgctttatgaactgattgaaaagtgtttgattaaagattatgggctgtcagtatatgcaaaggggagaactatcagaaagttctattcaatcaataacccgctgccggaatctgaaatcgcagatattaagaagagaaacaataattttaacatcgacaaaaatataaatgtatttgaggcgttcgagttctccatagaattcattaataaggagctgttcctgttgctgtgtcccaccatacatattcagactaaactcggaggtgaggtcaatcgcaatatctctcagtacctgtcaaacacaatcatcagcaataggtataataacaaatatgggaaaaagctgaattggtggattaacgagctcaagaagtataacaaggacttggtttttaaattgggggactttgagatacgattgacagattattactccacgagcgctaagcgcgttaaagatgacatctactgttttgacggatttactaagttgagtgagcccagtatatatttccactatcaagacgaagcaaagcagagtatccatcccataagtggactgaagatactcggtccattggaagaatcattcgaggcaaacggtacatcttccacagtcaaccttgccatcattactccggactttggcttctccaaactcaaggcgcacctcgaaagtttgcttaatacaatttcccctatatgggagaaggaatacttgaaggagttccctggtttcgataacgtttttaagaagcacctgataatacccaattctattcaaagcgagtatgtaatcagcatacctaataatgatgtaaaacagttctcagcaattcaattctacgactacctgaagagtaagatcgaccgactcgctctgaagtccaatgacattgattgtcttgtaatatacatacccgaccagtggaagaacttccgagagctgaaaaatgaaaacacatattatgaccttcacgacagtcttaaactctactgcgtaaaaaaggggttgcgaatccagttcatcgaagataaaagcattaattataaagaccaagccaagatccggtggtggctgtctctggggctctacgtgaagtctaacggcactccctggaagatcaaaacagataatacagagactgcctttgtgggcctcggttacgctatacgacaaaatgttaagaataaggttgttctcgggtcttcacagattttcgacggttatgggaatggtctcaagtttcttttgcagcccatagagaagccaattttttacaataaaaaccccttcatgagcaaagaggactcttttcggcttatcagtaatatacgaaacacatatcataagatcgatccagttatcggacttaagaaactcgtgttgcataagacaactcattttacttcagaggagatggaggggatctctaatgctttggaaggcatagacaatattgaactcttgcagattcagcaattctcatcatggagggcaattaagcttatgaaaaatgccacaaagcacgattttaatggttatccgatcgatcgcggaactataattcaactcgacgacttctctttccttctgtggacacacgggcttatagagaaccaagagctgaacggtaagtactaccagggaaaaagaggaataccggctccgcttcttattaagagatttagaggcacggatccaatagagacggtggcaaacgatattcttaagctgaccaagatgaattggaatggtgcagagctctataaaacctttcctgtaacgattgatttcagtaaaaaactttcagtcatggggaagtagtaactcgaggttaacttgt

SEQ ID NO: 321 - DNA, 3107 bp, Artificial Sequence
  Description of Artificial Sequence: Synthetic polynucleotide
ggtgtcgtgaggatccatgccaaagaaaaagaggaaagtcgaggatccgaagaagaaacggaaggtgggttccggttctatgccttcagctcaacggtgcatctgggagtggaagagggatatcttcgtgaccaagaatccgacgctccgggagtccgtggatgaacttagcttgccagggaccaggcgcatcgtacagggatggatcgaccagcaagcccaatacccggaagatgggtcagcagacgaatatagcttttatgccgaagagtgctacccaacctctcatgaccggcgagcgttcttccatcgcttcattgccgaggcgagaccgcatatcggctacaagctggttgcgcagttggcagaagcagggttcttgagaaccatttggacgaccaactttgacggactggttagcagagcgtgcacagcggctaacgtcgtgtgcgtggaagtgggcatggacacaccccacagggcctcacgaccgcaaggggatgacgaagtcagactggtgtccctccacggtgactttaggtatgacctgctgaagaacaccgccaatgagctgcgcgagcaggatttggcccttagggaggaactgctgcacgaactcaaagactacgacctggtggtcatcggatattcagggcgggacgacagccttatgcaagtgctctctgctgcctacagcgaccgcgcatcttgtaggctctactggtgcgggtttggcgcggaaccagcaccggaagtgaggcaccttattaagagcatcgacccagcccgagagagcgcgttctacgtggataccgccggatttgacgacgtaatgagcaggcttgcactcaggcgactgagcggtgaaagcctcgaaagggcccagaagctcatagaaagcgtcaccccggttgctggcaaaaagatggcctttagtgttccaccattggcccctagcgccttggtgaagggtaatgcctaccgattgacctgtccggcaaacgtcttgaaacttgatatcgaacttcccgagcacggttcctggcgcgattggctgtccgaacgaatgactccagaaagggggcaggccgttgtgttcgagaagggagcactggttttggccgacatggcggttaccgctaaagttttcgatggatttcttagggtgagcccgacacgggtggagataagtgacgagaacatcatcgctgacggccggatcgccagtctttaccgacgagctctcgtgagcagtgccgcaaaagcgctccagatccaaaccgaccacaggaggaggatatgggagcccgtgcactatgatacaaggcaactcgacgatgtgacgtaccgcgtgcatcgagccgtctccctgacgatagtagggatagagggagtgccccatgtggtgctgatgccagaggtcgtcgcatctacgttggcgggcgaccttgcgccggttgacagtcaaaagactctccgcaatgccatttacgggttccaacataacgataagtttgatgccgacctcagctattggacccaccgccttgttgagaaggagctggcttccagcggcgagggcgttttcgtattgagcaaagtgccactttatgcgggcctggcacaaaaaggtaaagctcctctcccacacaggtttgcacgccacgctaaacagcatggaattattgtgcccgacgcaccgcttgttttcagcgccaaggttggctctggagaggtacgaaaccccaatccgctgcatgggctggtgcaaaaccggccatgggaccactctcttacggcgtctggtttgtgtccgagtacagatgctagcgtgatctgccccgcagacgctgctccgaggtttgagagattcctccaatctatgcaggaggtagcaagaccaagccagagcgagagggactatttgcatgattttcccggcttccctgcggcctttggactgccactccgaatgcccgtgagaggggacgcaaactggattaccatcgacgacggagtgagcaccgatgccctgacaggggctaagcaactggcgcaccgagtgtgccaagcactcgaccacctccgcagagcaaggccctctgacacggcgatcgtgttcgttcccaggagatgggaaccatataaggtagtggacacgcagcacgaaagattcaatttccacgattacattaaggcctacgcggccaggcacagtcagagcacgcagttcgtcagagaagagaccatccaaagccaatacgtgtgtagggtccggtggtggttgagtttggcactgtatgttaaggctatgcggaccccctggcggctggatgcgcttgatgagaatacggcttttgttggtatagggtactccctggacgcagaggcagggaggggcaaccatgtactgctcggctgcagccacctgtattctgcgaggggtgagggattgcagtttaggctgggccgaatcgagaatcccgtggtgcgaggaaggaaccccttcatgagcgaggacgacgcaaggaggaccggagacaccatccggcagcttttctacgatagcaaaatgcatattccgacaagggtggtgatacacaagaggacaaggttcactgacgaggagcagagggggttggtacaaggattggacggtgtgaggaatatcgagctgatagagatcaaccaggaagagagcttgcgatatctcagcagccagatgaaggacggcagatttgagatcgacaagttccccctgttcaggggtaccacaatagttgagtcagatgacactgcattgctgtgggtgcatggagccacacccagcgccgtgaacaagtactggaggtactaccaggggaagcgccgcattccggcgccattgaggattcgaaggttcctcgggcaaagcgacgtagtgcagatcgcgaccgagatcttgggactgtctaaaatgaactggaatacgcttgactactattcaaggatgcctgcgactctggattctgcaggcagtattgccaagttcgggtcatatcttgatgggtttacgagcgcaccctatgattacagacttctgatctagtaactcgaggttaacttgt

SEQ ID NO: 322 - DNA, 2042 bp, Artificial Sequence
  Description of Artificial Sequence: Synthetic polynucleotide
ggtgtcgtgaggatccatgcctaaaaagaaacgcaaggtagaggatcccaagaagaaaaggaaggtggggagcgggagcgttcacgcattgctcgctctgctcgcgaaccgagccggtggaaggaccgccagaatgggagacagcttgctcacgtggagccctcctgagtctctgctgcttgaagggaccctgagctggcgcggcaacacctacacataccggcttcgcccactggcgagaagggtgctcaaccctaggaatcccagtgagagagacgccttgtccgcgttggcgcgacgactcctccgagaagtgcttgagcaattcaggcgcgaggggttttgggttgaaggttgggccttttacaggaaggagcacgcacggggtcccgggtggcgcgtgctgaaaggtgcggcgctggatctgtgggtttcagccgagggggccatggtattggaggtggatccgacttatcgaatcctgtgtgacatgacactcgaggcgtggcttgcacagggacatccacccccgaaacgcgtcaagaacgcgtacaacgacaggacatgggaactcctgggtctgggtgaggaggacccgcaaggcattcttttgccaggcgggctgaacctcgtcgagtaccacgctagtaagggcagaatcagagacggcgggtggggtcgggttgcgtgggtggcaaatcctaaagacgccaaagagaagatcccgcatttgacgagcttgttgatccccgtcttgaccctggaagacctgcatgaagaggggggctctaacttggccctctccatcccgtggaatcaaaggcaagaggaaacccttaaagtggccctgtccgtggctcgccgactcggcgtcgaacaccccaagcccgtcgaggccaaagcctggaggatgaggatgccagagcttcgcgcacgacgcagggtgggtaagccagcggacgcccttagagtggggctgtaccgggctcaagagactaccctcgcactgcttcggctcgatggcggcagaggatggcctgactttctgcttaaagcattggagaacgcttttagggccagccaggctaggcttcatgttagggaaatccacgcggatcctagccagccccttgcatttagagaagccttggaagaagcgaaagaagcaggtgtgcaggctgtcctcgtactcacccccccactgagttgggaggagcgacaccgcttgaaagcactgttcctcaaagaaggactcccaagtcaacttctgaacgtccccatacagagggaggaaaggcatcggttggaaaacgccctgctcgggctcctggcgaaagcgggtctccaagtagtcgcccttgagggcgcataccctgctgatttgacagttggatttgatgccggaggccgcaagtcctttaggttcggaggtgccgcatgtgctgtcggctccgacggaggtcacttgctgtggagtctgccggaagcccaagcgggcgaacggataccaggcgaagtagtttgggacctgttggaggaggcgttgctggtgtttaagagaaaaagagggcggttgcccagccgggtgcttctgctgagggatggcaggcttcccaaggacgagttcaccctggcacttgcaaagctgaggcagctcggcattggcttcgacctcgtgtccgtaaggaagagtggaggcggaaggatttatccgacccggggaagattgcttgacggccttctggtgcccgttgaagagaggacttttttgctcctgacggtgcatagggagttcagaggcaccccacggcccctcaaattggtacacgaagaaggtgagacacctctggaggctctcgcagagcagatctaccacctgacgaggctgtatcctgcatcaggtttcgcatttcccagactgcccgcacccctgcacttggcagataggctcgtgaaagaggtgggccgattgggcgtgaggcatctcaaggaagtagacagggaaaagctgttctttgtatagtaactcgaggttaacttgt

SEQ ID NO: 323 - DNA, 1946 bp, Artificial Sequence
  Description of Artificial Sequence: Synthetic polynucleotide
ggtgtcgtgaggatccatgccgaaaaagaagaggaaggttgaagatcccaagaagaaacgaaaggtggggagcggcagcgtgaggctggtaaaccagaaagagaaaccggaaggcgactacgtgtatggctacactctcccaatagaccccagtaacaggaacatgaggcagcccttctggataagcatggataaaaaggagggctatgaagctcatttcgttggcccctatgagaacattgagttgaccaagagcgtgatcttctgggaccttctgaggaggaccagggagcaactcagcagcgataagttcacggaatcaagaaaaaagttctttaaggagatctacttcccccttaacctctacaatgagggcagccaagggctcgccgtgcaaccctactacctgaagattgatcagcaatttggactgctggtggattttcaattcaaacttgacaaagatttcaccttcagccggaagattcaacagctcagtctgacattggatgggaagaaccggaggaacctcaactactacgtcgacaggataaccaaaaccaaccaattcatcaaggccctctggaacatcattggcaccttctcccataatgaaaacaaggaaaactacacgctgaggaacgacttctacccctgcgccgcaagcaggctgcggtctcgaatgtatctcttttccaatggcagtgaatccaggagccagttcaatggcttgaaggaatacggcccactccgacccctgacagccaatccgacactgctgtttgtgttccgggaacaagaccgcgacgccgcgagaaaactggcgatggcacttaaaggcagcaaaaagcaagatcaatacagcttccccgggttcaactccctgtttaaagcggacctgttgatcgacggaaatcccatggtcttgaaagacttttctatcgagagcagcagggaggtgttggccagggtgacaacatcaacatccagcttgttgcccattttcatcctgcccaaccgcgagggcgacggctacctggagcacaaagccatcttcgccgagaacggcatacctactcaagcgtgcacactccaagtcattcaggacgacgtgacccttaggtggagcgtccccaacatcgccctgcaaatattctgcaaagcgggtggctggccctggaaagtgcagagccccgtaaccgacaacgccctgattataggcataagtcagagccacaagttgaattatagtgacggtaagacaactgtggacaagcacttcgcttttagcgtgctgactgattcaagcggcctctttcagaaaattcaggtgctgagcgagcagaagacggaggagacctacttcgaacaactgaagctgaatctcaaaagcatcctgaacgccaatagcaagaactaccaacgcatcgtgatccacacctcatttaagctcaaatacaaagaaataagtgcaatcgaggaagttgttagcgaatttgcaaggaacagcaacagcgccgactgcaagttcgccgttgtgaaggttaatcacaagcataggtacttcgggtttaatcgggaagtgaatagcttggtgccctacgagggaaccgtgtgtaagctgggcgatagagagtacctggtctggttcgagggtatctatcaggagaagccgaccgttaccaaagcatttccgggtcccacccacatcgaatttcttaaaatcgggtctaataacgtgattagcgacgaccttttgttgcaagacctgatgaacttgagcggagcgaactggagaggctttaatgcgaagagtgctccggtatccatcttttactgccacctggtggccgacatcgtgcatgatttccaaatcaaaggcctccctatgcccgccatagatcttatacgaccctggttcatctagtaactcgaggttaacttgt

SEQ ID NO: 324 - DNA, 2210 bp, Artificial Sequence
  Description of Artificial Sequence: Synthetic polynucleotide
ggtgtcgtgaggatccatgcctaagaaaaagcgaaaggtcgaggatccaaagaagaaacggaaggtgggcagcggctccatgcaagaacacctgaagacgaacatactgaactttaaatggcccaactctgctccgaccatctacctgacattggaggacattgaggggagccaccctatccacaaaagcaaattttctagacagataaaagaagtgttccccgacgcggatttgagtaacaaggaccagatctttacgacattcacgaccgaaatcccagacgccccaagcataaaactgaaccttgtggacggccgagaattgcggatctataaacagttcctcaagcacaagctgcggtcatatttcaaatctaaggactacatcgtggtcaagaatttcgtgggcgacgttcaagtgtggatgccgagcaaaaagggtaacaccgcagattacaacctgtactataagtttagctttaagatccaatttgccaaactgacggacctccccgagctgatcgtaagctacgatggcacctccaaggtgctcacgacgtccgttaaggacatcgaagattcagagctcatcaagcgatgcgtctacggccaaaagacgtttaactaccaaatggacttggacaccgaagagaagcaagagttttacaacgcgatacagtttgaccaggcctacccaattttcaacctttccctggcaagggcactcgacatccccatagaggagccaataaggccgatcaacaaataccaaaaatacgtagccctgattaacaatttcgcaactaattaccttttcaaggaggacttcaaggttatcttcccgtttaaaacagacacgttcatcgacgtgcctataaatcggataaatcacatcgacccccaagtcggcctgttggaattcggaaaagatcaatatggcaacaagaaaacccacctggtacctaaaaaggcaatgaacatcttgaatccataccggcgacctaataatcagaacatcaaaatctttttcatctgtcacacaagccacaaagactccgtgctcagcttctatcagaatctgaaggaaggagtaaacacggagaagaactactacaaaggacttgaagcctacgtgaacattaaggcaagtagtagcaaggagcattttatcgagttcacgaacgagaatgaccccatcccggagatcgtggagaagcttgagagcctcacatttgatcatgacaatgttctctacgcggcgttctatctctcccccttcgacaaattcacccagaatccggaggaccgggaaatttacatccaaataaaggagttgttcctgaacgaaggtatcgtgacccaagttgtcgattacgagaaaatggtcgtcaatatcgagaatcagtataacttccagttcagcctgcaaaacatggccctcgccattcatgctaagctgggcggtgccccgtggaagctggccgtgaccgacaagaaggaattggtcatcggggttggagcgtttacaaatcaaggcgagaacagacgctatattgcttccgccttctcctttcagaataacggcctcttccgcaagttcgagtacttcgatcaaagcgagaccgacctcctggctggcagtatctgcaaagccatccgcgacttcaccagcgtagcggaggcagataaggtcgttatccatttctataaggagatgagttacgaggagcttaaacccatcattcggggcatgcacacgcttgggctgaagatacccctttacatacttaacataaacaagactgaagccgaggatattatcgcctacgacctgaattggaacaaaaagctgatgcccgtcagcggcacctacattcgcatctccgaaaatcatttcctgctcttcaataacgcacgatatcctaattcccaacggtacgccgacacggatggttacccgtttcccattaagattaaggtcagctctccggacgaggatgcctttgaagatgcagatgtggtcctggagctgcttactcaggtttatcaatttagtagactgtattggaaaagtcttcgccaacaaaatgtacctatcaccatcaagtacccagagatggtagcccagattgccccccatttcaacaacggggtgcccgacgatgccaaggatgctctgtggttcctgtagtaactcgaggttaacttgt

SEQ ID NO: 325 - DNA, 3257 bp, Artificial Sequence
  Description of Artificial Sequence: Synthetic polynucleotide
ggtgtcgtgaggatccatgcccaagaagaagcggaaggtggaagatccgaagaaaaagaggaaggttggcagcgggagcatgactgaggacttgtacctcgactacgacgcgttcctgcggagctttaaaagaaacatagatgtgccgcactcctttctcctgggagcaggtacatccattagcagtggcatccagaccgcctacgattgtatctgggagtggaaaaaggacatttacctctccaagaacatcaacgccgctgagttctataagaaccataaggacgaggcggtaagaaagagcatccaaaagtggctggataaccaaggtgaatacccagttctcgacagcacggaggagtattgcttttatgccgaaaaggcctatcccatccccgaggaccgccgcaagtattttctgtctcttatcgaaaataaggagccctacatagggtataagctcctctgtctgctggccgagcgcagcattgtaaaggctgtctggactactaatttcgatggcttgaccgtcagggctgctcatcagaacaagttgacgcccattgagataaccctcgataactctgatagaatatttcgcaaccagtctaccaaggaattgctcacaattgcgctgcatggtgactacaaattctctacgctgaaaaatacggagaaggagctcgacaaccagaacgacacattcaaacagcagctggggacgtatcacgtggacaagaatatgatcgtaataggctactcagggcgcgacaagagcctcatggacgccatcagcgaggccttcagtacgcggggtgcagggaggctttattggtgcggctatggcgagacgatccccaacgaggttagcgagctcatactgaaaatcaggtcccagggtcgcgatgcatactacatatcaacggatggatttgacaaaacgctgatacacctgtctaaaagtgcgttcgaagacaaccccgagattacgaaaaacatccaactcgcgctcgaaaacagcgcggacgaagagtactttaagactgacttttcactgaactttagcaagccggataagttcatcaagtcaaacctccaccccatcgtgttcccgaaagaaatctttcaattcgagcttgacttcaaggaggacaagccttggcaactcctcaaaactatttcacgcgagacaaacatttgcgccgtgccgttcaagggtaaggtgttcgcactgggcacgcttactgacattgggaacgtcttcaagaaccgcctgaagagtgatataaagcgcgaagcaattagcacctccgacgtggataatgtgagtgcctttaaatctctgatgctgcaggctgtgctgaagtttttcattggtatcgaaggcgtggagtccaacctcaaagacagattgtggcttaccaacgcggagcagctcgtgggtgatattagtgtgcataaggctatccacctcagcctgtacttcgacaaaaacaaaggattcgcttacctgtccttcacccccaccgtacaactcatctctcctgaggaaatcagcaaaatccagaagcagagaatctctaagagtaaactcgagaagctgttcaatgacaagtatgacgagatattggagttctggaaccaaaagctctttaacaatagccaaatcaagttcgagtacccgatcagctcaggtagtgggtttgagttcaaaatctccgccaacaccgcatttggggagataaacgtattggaccccaactttcgctccttttcccctagaaattatgacccgaagcgcacacagtttaagggcgtgcagttcctcgaaccgcagctgatattccgcaacatcagtactaatgtggaatttaaggactaccacccgatgagggggctggtgaacaaccgaccgttcgacgtgaacctgaacggtataattcattctaacgaaataaacctcacggtcatctgcggcaagtcatacgccaacgacctgtatgaattcctgagcaagctccaagtgaagcacgccactgagaatgtcaacccggactatcttattgagtatccgggcttccaaagtgtgttcaacctgccactcaacataccccactttgactcttccgagaagtggtacgacatcgacttcgtagctgacaataacggggagaaccacgagaatgccattaagcttgccagactcatcaccaccaagatcgaccagattgcctctacacagaaccagagcacggtcgtggtgtttattccaaatgaatggcagttgtttgaggggtacctgaatcagggggagagtttcgatttgcacgattacatcaaggcattcagcgctagtaggggcatttcaacgcagctcatccgcgaggatacactggcggatacgttgaagtgccagatctactggtggctgagcctctcattttacgttaaaagcctgcgaactccttggattctgaataatcaagaaaagaacacggcctacgccgggatcggttatagcgtgactaaaatacaggaccggacggaaacggtgatcggctgttcccatatttacgattccaacggccaggggctcaagtatcggttgagtaaaattgacgactacttccttgacaatcgcaataatccatttcttagctataaggatgcgttccaattcggtgtgtccatacgggaattgttttaccagtccctggacaaattgcctgagcgggtagttatacacaagcggacccgatttaccgatgatgagatcaatggtattaaggcgtctctgaacaaggcggggattaagaagattgacctggtggagattaactacgagacggacgcccgcttcgtggccatgtccgtataccagaatgcactgcaggtagaccgattccctatcagtcggggtacttgtatagtcacaaataagtacactgcccttttgtggacgcacgggattgtcccaagtgtacggcagccaaactacaagttctaccttggcggtagaagcataccggctccgatcaagatcacaaagcattatggtgatagtaatatagacgttatcgccaccgaaatccttgggctgaccaaaatgaactggaactcccttgacctttatagcaaacttccctctacgatcgactccagcaatcagatcgctcggattggcaaactgctctcccggtacgaaggcaagacgtacgactatcgattgtttatctagtaactcgaggttaacttgt

SEQ ID NO: 326 - DNA, 2150 bp, Artificial Sequence
  Description of Artificial Sequence: Synthetic polynucleotide
ggtgtcgtgaggatccatgcccaagaaaaagcggaaggttgaggacccaaaaaagaagaggaaagttggcagcgggagcatggaaaatctgaccctgaatatcatccctttcagccaccccgtgcaggagcttgagatcggcttctataagcaagagaaacagggatgctacagcctgtggaagggcgagtacccgcagtcattctgggacgacttcaacgaggaaatgcaaaattgcgacaaactctacaccaacttcattgacacggaaaactgtgattacaaagccagtgtggactttagcaaaaacagacgcctggcggtccattactacagcaggctgatctacaactactttgaaacagtggcagatgccgtgaaaatcaacttcgtgaaagatatccagatatggttcaaggacgagaccaagagcaccgccgtctataccagttacaagcggttcacgatcaaggtccagttccataaggtgaccgagtccccagagctgttgatcagcttcgatggcaataccacggcctataacaaaagtctggccgagttggacgatttccctcccgagctgattaactacgttaagtacaatacccaagtggtgaagtacgagttcgccgaggacgctattaagcagcatatcgaggagctgtacccgatcctgagcaaccccatcagggactaccttaagattgccaggcccgattttaagaggggcaacaagtataagccctactacaagaacattacagacttctatcacaaccacctgaactccaaagagtttaaagctatcctgcctatctccgaagacggtttctacaaaatgcctaagcacaaggttcacaaaaccagcttcaatagcaataaactgagatttttcaataacacggacatcgtgccccacaacgggatgaaaaacatcggcccctataaggcgtccccccaccccaacgtgaggttcttcttcatctaccataagccagaccgaaacttcgccgtcaagacgctgtacgaatactttacggaagggtacaagagcccagagggctacctttacttcaagcctctcaaaacctacattaaacagccctttctcatcgacaaggataccagcatcgcgttcgaaagcccggaaagcgctctgcgcgaagtcaagcagggtttgcttaacctggaaaagcagcccaatacgaaatacgtcgctatctatgtgacccccatacataagaccgagaccgacgagcagaggaagatgctttattaccaggtcaaggaagaattgctcaagcacgacatatcaagccaggtgatatacaaggacaacattggacataaggattttagtttctatctgcccaacatcgccatcgccctgctggccaagatcgatggaatcccctggaggctggacagagacactaaggaggaacttatcgtgggcgtaggcgcattcacaagcctgaaccacaatatcaaatatgtagctagcgccttctgctttaacaacaatggggaattcaagggattcgactgcttcaaagcgaatgaaaccgaacttttggctggcaccatcggcaagcaaatcctgaagtatgtggtggacaacggcgagagcgccaagcgcctgataatccacttttacaaaaagatcagtaacaaggaactcgagcccataaagaaaatgctgaacaagctgaacctgaccatccccgtagtgatagtgactatcaacaagacgacctcagaagataacgtggcgtttgacaccagcagccataacctgatgcccgtgagcggcacctacctcaaaataggatgggaccagtacctccttttcaacaacacgagatacaacgccagcgacaccgagaaggataaccccttccctgtaaagctgagcttctctagcaccgtagacaattacttcgacgacaggaaggtggtcgaggaattgatcgaccaggtgtatcagttctcccgcatgtattggaagagcgtgaagcaacagaacctgcccgttaccatcaagtaccccgagatggcggcagagatcttcccattttttgaaggcgataagctgcccgacttcggaaagaataacctttggtttctgtagtaactcgaggttaacttgt

SEQ ID NO: 327 - DNA, 2216 bp, Artificial Sequence
  Description of Artificial Sequence: Synthetic polynucleotide
ggtgtcgtgaggatccatgccgaagaaaaagcgcaaggtagaagaccctaaaaagaagcggaaagttggcagcgggtcaatgaacacgcctttgacgcattacgtgctcaccgagtgggaatccgatacaaatactaatgtattgcacatccacctgtacaccctccccgttaggaacgtgttcgagcagcacaaggagaacggtaacgcatgtttcgatcttcgcaagctgaataggagtctgatcatcgacttctacgaccaatatatcgtgagctggcagcctatagaaaactggggcgagtacaccttcacccagcacgaataccgcagtataaacccaacaatactggccgagagggccatcctcgaacgactcctcttgcggacaatcgaaagcgtccagcccaagaaggagatcgcagctggttcccgcaagtttacctggctgaaggcagagaaggtcgtggagaacattagcatccacagggtaatccagtgcgacgtaaccgtggactacgccggcaagatctctgtgggctttgacctcaatcacagctataggacaaatgagagcgtgtacgacctcatgaagtctaacgccatctttaagggagaccgcgtgatagacatttacaataacctgcactacgagtttgtagagatttccaactccacaataaatgactccatccccgagctcaaccaaagtgtcgtcaactactttacgaaggagcgaaagcaagcatggaaagtggataagctggaacagagcatgccagtcgtgtacctcaaggcattcaacggcagtaggattgcatacgcgcctgcgatgctccaaaaagagctgacctttgagagtctcccgaccaacgtagtacggcagacgtcagaaatattcaagcaaaatgccaatcagaaaatcaagaccttgctggatgaaatccaaaagattcttgcccgcaccgacaagatcaaattcaacaagcagaagctgttggttcagcaggccggctacgagatacttgaactgtccaacccaaacctccagtttgggaagaacgttactcagacgcaactgaagtatggactggataaaggcggagttgtggcctccaagccgctcagcatcaatcttctggtctacccggaacttatagacaccaagctcgatgtgatcaacgatttcaatgacaaactgaacgctttgtcccacaaatggggcgtgcccctgagtatcctgaagaagtctggagcgtaccgcaacagacccattgatttcactaacccccaccagctcgcgattctgttgaaggaactgaccaagaaccttttccaggaactcacgcttgtgataataccggaaaagatcagcggcatgtggtacgatctggttaaaaaggaatttggcggcaatagcagtgttccgacgcaatttatcaccatcgagacacttcagaaggcaaacgactatattctggggaacctgctccttggcctctatagcaagtccggcatccaaccatggattcttaatagcccccttagctccgactgcttcatcggtctggacgtatcacatgaggcgggtcgccacagcaccgggatagtccaagtcgtaggaaaggacgggcgcgtgttgtcatccaaggcgaatacgagcaatgaagccggcgagaagatccgccacgagaccatgtgccaaatagtgtatagcgccatcgaccagtaccagcaacactacaacgagaggcctaagcacgtgaccttccaccgcgacggtttttgcagggaggacctgctgtcactcgacgaggtgatgaactccctggatgtccagtacgacatggtggagatcatcaaaaaaaccaatcggcgaatggcactgaccgtcggcaaacaaggatgggaaaccaagccaggactgtgctacctgaaggacgagagcgcctatctgatcgccaccaatccgcacccgagggtgggcaccgcgcaacccatcaagattatcaagaagaaggggagcctccctatcgaggccattatacaggacatctaccacctgagcttcatgcatatcggctcactgcttaagtgccgactccccatcacaacttattacgccgatctgtctagcaccttctttaaccgccaatggcttccgatcgatagtggcgaggcccttcacttcgtgtagtaactcgaggttaacttgt

SEQ ID NO: 328 - DNA, 3230 bp, Artificial Sequence
  Description of Artificial Sequence: Synthetic polynucleotide
ggtgtcgtgaggatccatgcctaagaagaagcgcaaagtcgaagaccccaagaaaaagcgaaaggtgggctctggcagtatgattaacaaactgcaattcgacgagtttcagagggccataggtatttctaagaacgacaccttcagtcttttgctcggagcgggttgcagcatcaatagtgacatccctagcgcggaagactgtatatgggagtggaagcgagatatttacaaaacaaataacagttctagcttcggctggattgacaattacaagaatcccaagactcaggagatcattcagaactggctcaacaaccaaggcatctatcccgaacgcggctgcaaagaggagtacagcttttacgcctacaaatgctatcccatcgacgaacataggcgacagtattttcagaaaatctgtagtggtaaaaagccatccatcgggtacaaacttattcccctgcttgcccgaaagggcatgcttgatagcgtgtggaccacgaatttggacgacctcgtggtgaccgcctgtataggcaacgggatccaggcgatcgaaatcacgctcgactccgtgcaaaggttgaacaaccggcctcagaaccgacatgagcttcctgtgatcaaactccacggagattttaagtatggcgatcttaaaaacaccgaggaggaactcctcaatcaggataaaacgttcagggagagacttattgaatacgtacaagacaagcacctgatcgtgctcggctacagtggccgagacaccagcctgatggacacacttaaagaggcctactcaaaacaggggggtggaattctgtactggtgtggatatggtgacaacataaactccgacatcgccgaactgattcaaatagccactaaaaatggccgacgagccttttacatccccactgatggtttcgattctacgctccggaaaatcacacagatagtggtcgaggatgataacaacctgaaaaaagagcttctcgagcttcaccagaccagcaatatcaatgacactatcacaccttttgatctgaagtgcgagagggtgaataagctgttgaagtcaaacatattccggattagctttccagacgaagtgttcgttttcgatgtgagcatcagcgataaaccctggaagttcgtggacgaaaggactcttgagcgcaacgatattagcgccgttccctataacaagcaaatctgggcattcggtaggcttgacatcataaaagacatcttcaaagacgtgatgaactcagacattcagcgaaaacccctggcaaacatcaagatatacaacacggcggttagtcggctgttgcttactacgatttgcaagatactggcgctgcagagcaaccttaagaccgactataagggtaagatatggaccgagaacaacagtaagtccatttccggccacatagtatacaatgccgtgctgctgtcctttgatcggataagcggtgagtattaccttagcctcaaccccgacttcgtgctggctaaccccaacattgagaagagtagcatacagaccataggactgttcttcttccagaagctgtggaatcagcagtttaacgagtacattaactattggagggaaattttgttgaaaaagaataatgagtacgagttccccataaatagcggaaccggcttcaagttcaagatcaagaacatcccagtgttcactaacatctgcgacctgaataaccctcgcatcaacaatcacaacgtgtccagccaccacctgctgcttcagggggtgcaatttaaggaaatcccgctgcttttcagcaccaacaatggcaaccgcacggccaccgacacccaccctatgagaggacttctcataaacaaaccgtatgaaacgggcgtcaacgacttcctcgaaaagtctatcaccctgggaatcataagccccagtcaggacgccctcaggttctaccaattcctggaaaaccagaactctaaaatcaaaaagcacaacgacaaggacaactacataatagactacgaagggtttttcgccatctacggcgttagtctcagcttcccaacacctaacgacaacgagtgggaaaggatcaacgaaccgctgattatgggcatcaaggagaccgcccaacagataaagcaactgatatgcgacagcatcgtgaagatctcaagcacgaccaggagaaaaatcatcgtcatctatatcccccaacgctgggagccctacacctcttaccagctcgatggtgagtcatttgacctccatgactacgtgaaagcgttctgcgcggagaaagggattatgagccaactcattcgagagaagaccattaacgatactatccaaaaatgccagatacattggtggttgtctctgtcatttttcgtaaaatccttccggaccccatggattctcgcaaatactaacaacaccaccgccttcgcgggtttggggtacagtgtagaaaacaagaaggatattaacggacatattgtgctggggtgtagccacatttacagctcaaacggagaagggctcaaatacaagctggccaaaataagtaatgataagattcagtggaggcataagaagccgcacctctgctacgacgacgcgtatgagtttggcaagtcaattgtgaacctgttctacgaatctatgaacgaactgccaaaaagggtggtcatccacaagaggaccttctataccgatgaagagaaacaagggatcatagactccattagcgacaataagaaaatagagagcatcgacctcatcgagatcaactttgaaaacaatataaagtacgcctctagcaaaatccacgacggaaaggtagacattgacggatttagcgtatctaggggaacctgcatacaactcagctctaaggaggcgctcctgtgggcgcatggagtgattcctagcgtcattaaccctaactggaacttctaccctggcggcaggtacatacctaaaccacttaggatcattaaacattacggtacaggtagcttggaacagatcgcgaacgagattctgggcctgactaaaatgaattggaatagcctgaacatgtacagccaattgcctgccacaatttcaagctccaatgatatagctaggataggtaaattgataggggcgaacagtatgcacgaatacgactaccgatacttcatctagtaactcgaggttaacttgt

SEQ ID NO: 329 - DNA, 2018 bp, Artificial Sequence
  Description of Artificial Sequence: Synthetic polynucleotide
ggtgtcgtgaggatccatgccgaagaagaaacgaaaggttgaggaccccaaaaagaaaaggaaggtggggagcggcagcatgaataacatacccatcaggctgaactttttcgccctgaagaaccagaacattagcttcaggatctacaggcaggacttcaacggccagaaaaaacaggacgggtactacaggaccaagctgcccatcaacgactcttctgacacctacgcggagtactgggtgacaacccagcccaaggatggcttcgagagggtgtactgcctgggttcctcaaaccctaagctcaccgtccgaatcatgtgggagagcttcctggatagggtccagaagtccctgagctccgacgaatatatcctttacggtaacggatttagccggaaggtcgccgtgatcatcggcaggcacagggagggcaatgaggtgatccagatagagccctattacctgaaggccgagaagaagttcggctttctggtggacttcgcatttaagaaggccaaggacgtgccctatagcatcagggttcagcagctgagcctgtcactgaacaagtatgggaagagcaacgccgactactatagcgacaagctggataagataaagttctttatgcagaagtttaagcagaggcttttcccatttagcttggataacgaggattacgacatcgagaacgagctgtatctgatgaggagctacccgctcaagatgaagacctacatattctctaatggcaaggaaagcaacagccaggtgcagggtctcaaaacctacggaccgctggcgaatctcgataaggagccactgttcgtgttcatgttcgagtcccaggacaggaacgaggccctggagctctattctagcctgctgggcaagacgtacaccaacatatttgctggcatggagagcgtgtacaaaatcaaactcgcaaaagagaatgtgaagcacatcatcatccccagccttaccaaggagggtctgcaagtggtggagcaagagctgcaaactatcgtggagagtcatcaggacaagaaggtgattgggatatttgtaatgaatgaaaaggtgccctcatccatcaccggtttcagcccctaccactacgtcaagtacatcttcacagagaaacgcattcccctccagacagtgaggtgcgagaggatcgctgccagggatggcctcaaatggagcgttggcaacatcggcctccaaattttcgctaaattgggcggcatcccctggaaagtcaagccgagtaacgataagtgcatcatttttggcctgggctgcgcccacaaaaaagacgaactgggaaacattaacaaatacttcgcctacagcgtgtgcatggacagcagcggcatttaccgaaagattaatgtgctcggcgatgcaaaggagcgcactgattacatccttcaactgcgggagaacatcaaaagcgtgataagcgagaatctggacgggagcattgaaaagtgcgtgattcacctgcccttcaaaattaagaacgacgagatcaggtacataaaatccagcgtgcaggagatcgcgcacctgtattccgacatagaatttcaatttatcaagatcaacacggacaacaagtttttcggatacgctgaaaacaacagcaaggtaccctacgagagcagctacatacaactgagcagcaacgagttcctggtgtggttcgaaggcctgcagtacgggaaggagctggtgaagaaaaaggtaggtaaccccgtgcacattgagttcatgcagatcgatgagttggatcccgaaaagaagcggcgatatctgcaggatatcataaacctgagcggtgccaactggcgaggttttaacgccaaactgtctccaatcagcatctactaccccaacatcatagccaatttcatttcagagttcagggagttccagcccgaaggcgacgtggacctgaccaacttttacattccctggttcctgtagtaactcgaggttaacttgt

SEQ ID NO: 330 - DNA, 2870 bp, Artificial Sequence
  Description of Artificial Sequence: Synthetic polynucleotide
ggtgtcgtgaggatccatgcccaagaagaagcgcaaagtagaggaccctaagaaaaaacgcaaggtcggcagtggcagcatgcataacatcgaaatcaacaccttcgtcaacagctttgccattaaacccaacaactccatgtccttcctgctcggcgcaggcgcgtctatatcctccgggatcctgtctggcggacagatggtgtgggactttaaacggaacctctattgtgcgtccaaaaacatacgcaccagcaattttcccgatatgagcaaaaagaatgcgcaggacgagatccaacgcttttttgatgggcaggccggaaatcctagcctgtggtcctccgaggagtatagtttctacttcgagaggtgttatccggcgaggaaagacagggagctgtacatacagaacaaggtacgagacgtcaagccgtcattggggtatctctgcctcggggaattgatcatacacgagaagatcggtgtagtatcaaccacaaactttgatgacctggtgttggccggcatccattcaataagaccggacctgagtgtgaagaccatcagcagtgccctcaaaaatagcacgggattcttcgtgaacgacgggttcccgaacatcattaagctgcacggcgattacttgtacgataagctgaagaataccgataaggagctgcaaaagctcgagacggagatcagcggaatttttcgagatgccgtcaagagtggcgggctcatcgtacttggctacgccggcaacgacaacagcgtgatgagcgtcctggaggagctcgtaagctccgggcaaatcaggtacggcgtgttctggtgccaaccgaagggcttccccctgtccaagcgagcgcgggagtttattgagaaggcttgcgcctacaatgaggaatccggggttgtcgagatcaacaattttgacgactttatgtaccgcctgttccttacactcaacatccaaaactcatttatcgacagcatgtgggaacagagcggcatgaagcagccgatcctctatgagaatatcggacgacacaagtccaccgccgtgacgaacgccctgtgcgccctgcagtacccccgaaaatgctacgtcttcaacgcgaatatatcaagctggaaggaactgcgcgagacgataaacgacacgtgcgtggcagtgctgtataagggcatggtttgggcgctgggcagcaaagcaggcatcgtgcatgcgttcgccgggaagatcaatggagacatatacgaactcgacatcccgttgtacatgatgaaactcgaggattctgacatcctgggcatgttttacgacatcataggacgcggccttcagcgaaaggggctggtgagctacggtaataggaaacatcacaaatacttcaacccctccagcaaacggttcaagaacggtcaaaacatctacgacgcggtcaagatatcactgagtttcgtggacgatcagctcgtgctcatcctgctgcctacggtgcatctgctgaaacgcgacgggacggagctggagaaatttgactaccaaaaattggtgtcccaggagatggcaacacactacaacaaagtggtggacagcgagatagagatctggctgaaattcatctctaataacggcaagataatctttgagctggggaacgcaatactggaatttaacaacgtccgcatccagtactctggtaacggtaacctcagcaagtgctaccaggtgagcgagcccgagctcacgttcagttacgaaaaggacaactgcatcgctaccaaccaactgcggggtctgatcaactatggacccatagagacttacgtgaacaaagccatcaggttggctgtactcagccctaaggagtgtgccgcggacatttggaaacacctgcagaagttgaatgagcatcacgtcacctcccttattcaggatgcaaattttctgccggagtacaccggctttcagaacgtttttaggtgcaaccttgacattcccaatgggaacgatgtgcataggttcaaaggctacagtatagacaaggtcatgcaactcaacgcaaagagctacttttacgggatctgcaagtacattgatgcattcgagacacaaaggagccaatacgacctcctcgtcatctatatacctaagcagttgacccacatccgagaggccaagaataacttcgaatatttcgacctgcacgacagcctgaagatttattgcgctggtaaaggtatagtcacgcagatcatcgaggaacacagtgtttatactaacaatgacaccgccaagatcatatggggtctctcaacggccatattcaccaagaccgccggaaggttgtggaaacccagacgctattccatgaacaccgcttacgtcggcctgtcatatgtgcagagcgttaagaacaacgagaaagtcagcatcggttgcagtcagctgttcgacgccgaaggcaatggaatgaagctttacctgagacccttgatgaacccccagataattcaaaataacccttttatgcggagcgacgacgcttgcaggcttatgtcaaaccttaagcggatgtatgacgacagtgtcccgctctacaaactgaataggatcgtgatccacaaaactacgttcttcactaaagaagagatggaaggcatcaccaaagggctggctggagtggatgacatagagttgctccagatccaggagttcacagcttggcgagcaatacgcttcgactacgacaagatcgcaccgtttccgatacagaggggcacagtgattctggggtggggccactttagttacttggatacctggaagtgtaccacctagtaactcgaggttaacttgt

SEQ ID NO: 331 - DNA, 2390 bp, Artificial Sequence
  Description of Artificial Sequence: Synthetic polynucleotide
ggtgtcgtgaggatccatgcctaagaagaagcgaaaagtggaagacccaaaaaagaaaaggaaggtgggtagcggcagcatgaacgccgtgaccgtgggcagcaccccaagcgcccaggtactcgtcggtgttcagccatacgacgaaaccaccctggagagcctgagaagtaaacaccgcggagactatctctttaaaagggggggagagaacggcgatagcatacttgctgtggccctgaaaccgagtctgccggtcatcggagcaaccgaggaggatgtaattcttgccgagagcccatggttgttggctccacttgccttggagactttgctgcaatgcttcgtgaggcttcaaaggcccatcctgaaagctaggcatcccctgagagtgctctcacaaaaaccggcaaatcttttcccagccgatgcgggggtcccccagtggctgcagaggagactggtgctggaattcgacacgcgcactgttagggacaggtcagacgctgcctctgtcgtgctggcatgtggcgtgaggactcggaatttgattgatgccgactgcgcgacactgatagcagccggtgtcccccttgtgaatcgatacgtggtgacgaggcaccctgcggatgatccccgagtgcagggctatttgaggctcgccgggagggtgaccaggatagatggccccaacctgtacttggaggatcatggcgatggagcagctgtgatcaaggcctccatggcctatctggagcccaggagggagaacgtgatttggtgtgcccaccatttgctggggagaaatgcggatagagtactggcggaagcggataacgcagccgcaaagcacttgagcggtcccgaacgattggccgtagtgaagaagactttcgactaccttaggagccagaacatcgagcttgcgcctggagtgcccctcactctgggtaacgttgtggggaatgacaagggttcttggatcttccggacggaaactctgcccaagccccacctggtgttcgacccgagcgggacccggatcgataggtggaatgagaggggattggacgctcacgggccctatgatcaaaggaccttcacccctaaacaactgaggattgccgtcatatgtcaactgccctacgaaggccaggtcgatgcgttcctggcaaaatttctcgacggccttccagacgtgaagaccggctacggggaccgggccagggcgccttatgccaaggggttcatcaggaggtacggtctggagaagcccaaggtgagcaccttcgcaacaaaaggcgctactgctaaggactatgccgctgcatgtagggcggctgtggaggacgcaaccgcaagcggcttcgagtggaatctggctatcgtgcagatcgacaaggatttcaaggagctgagtgacgtggagaatccctacttcaccaccaaggccctgctgctgaagcatcgggtgcccgtccaagaggtgacgctggagacgatgaggttggcagacgaacagctggtgtacgtgttgaacaacatgagcgtagccacctacgccaaagtgggcggtactccctggctcttgaaagcgcaaccaaccgtggcccatgagttggtagttggaatcggaagccagacttttagtgcctcaaggctgggtgagaaagagagggttgtaggccttaccaccgtgttctcctccgacgggaaatacctgctggacgaccggactagcgccgttgattacgacaactatagcgaagagctgtttaagagcttgtcccggtcaatagaatcagtaaggatcgccgataactggcgaagtacggacagtgtcaggctgattttccatgttttcaagcagatggcggacgaggaagccgacgcggttgacaagttggtgcaaaagctgggtttggcacaggttaagttcgcgtttctgcacatcgtggatgaccacccattcgccctgtttgacgagaagaacataggtacaaagacatggggtgggatattcaagggcgtcttggcaccggaaaggggcctcgcggtaaacctctctggggccgaaaccctgttgtgcttcacaggcggcagggaactgaaacaggcgaaggatggcctgcccgtgcctagtctgctgcgactgcaccacaggagtacgttcagggacatgacctacctgacggggcaagccttcaacttcagctgtcacacctggcgcatgttcacacccgctcctgttcccatcacaatacattacagcgagctgatggcgcgactccttacgggcctcaggcacgtcccggattgggatccagacacaatgctgacccccatcagtcgaacccggtggttcctgtagtaactcgaggttaacttgt

SEQ ID NO: 332 - DNA, 2207 bp, Artificial Sequence
  Description of Artificial Sequence: Synthetic polynucleotide
ggtgtcgtgaggatccatgcccaagaagaagcgaaaggtagaggacccaaagaaaaaaaggaaggtgggctccggatctctggacagtttccacctcgtgcagacagagaaaaaggccatcgcaatgccaaagcagaagcttgcggttaatgcactccccattagcctgaaagagcaggagcagcacaagctgttcttttttagcaaggaaaagcagggcgagcgagccccgctcaccaggaaagaatatcctgacagcttcgccaagaggtaccccaagagctccaaagagtacgacgtgctgtacacggacttcaccccagagccagctgaggatgggtttgaaattgatatcgacctggaggaggcacctggccttgccaagcactacttgcacaaaaggatctttgaggcctttaagggagtagctgacttcagaaagcgggatttcatcaacggtgtggagctttggttcagggacaaacccgccgacgaagttaatttccgggcctacaagaagtttaagattaccacccgcagaacttggttctccgcaggctgggccctgttcatacaatacaccggccattcctttattcacccggtggcgatcaatagcgaagaggccgcagtggacactacggaactcacgcgggttgcttataaccgacacatcttccactacgaggagatccccgaagacaaactgagtgagatagatttcagtaagatgtaccccgtggtgaacttcaacattagggataaaatgcagcagttccccgttatcgatccattcaaaaacaaggtcaaggaatatgtcgacgaaatagacaggttcaagaacatgtatctgatcgcgccagcggttgaggaggtgcttccgtttactttcaacgacgacaactggtgcgagatcaagatcggcacctaccataccgtgcccaatgccggttccaaattggttttccgcgatgggcaaaccgagatacacccgttctacggtatcaggaaccacggccctttcatgccccccaaacacagccacataaggtttttgtttatcatgagcaagagggacatcaagggcgctggtaagcaattctatgaatacttgaagggggaggtaaaaggagtggacgggttcaacaggtatgctaatataccgtcatccctgaggggtgagatgatcgagtttgagaacgagcaaaaccccctgccggagattatcgacggcttgaacaacatggagcgagaagcgggcgtggcctacttcgccttctatatcagccccatcgaccgagaagtgaggaacaggaaggagaggttggtgtactacagggttaaggaggagctgctgaagagaaagattgcctcacaagtggtagaaaggagcactatcgagaaggccgacttccgctacagcatccccaacatcgccgttgccacagtggccaagctgggaggcatcccgtggaagcttactcaacccccagaagcagagctgatcgtgggcataggcgcattccagccacgcgagttcgacaagcgatatctgggcagcgccttttgcttccaaggcgacggaacctttagcggcctgaggtgtttcaccaaggacgaaccccatatgcttgctggcagcatcagggaagcggttcaaaggtacgccgatgaaaacaggcaagtggaacggctggttatccatttctacaaaaccatgagctatgacgagaggaagccgatcctggccaccttgaaagaactcggcctggacattcccgttgtggtggtcactatcaacaagactgaatacgagcagacaatcctctttgacctgaattctagcatgaggctgccgctgagtggtacctatttcagccagcgcagggacgacatcctgctgagcaacaacaccaggtaccgcaaagacagcgaggtgaagaggggtttcccttttcccgtgagactgcagctgtggtgctccaaggagggcctgctggacgacgagggttttagggagcgactgatcacccaagtgtataggttttctcggctttactggaagagcgtgtctcaacagaatctgcccgtgaccattaagtatcccgagatgctggccgaaaagttcccatactttaactcaaggagccttcctagcttcggcgaaaaaagcctgtggttcttgtagtaactcgaggttaacttgt

SEQ ID NO: 333 - DNA, 3113 bp, Artificial Sequence
  Description of Artificial Sequence: Synthetic polynucleotide
ggtgtcgtgaggatccatgccgaaaaagaagcggaaagttgaggaccccaagaaaaagcgcaaggtgggcagcggctccatgcttatctggcaattcaagagaatgctctactgccaggccaacaacatcaaagaggaaaaattcaaagacctggagagcgagcgaaatcaaaacactatccagagctattttgacctgaagggcggctatccggaaagatatagccaggaggaatactccgcttatttcgagcattgcttcccgaagtctatcaaccggaagtatttcatgcagaaaatagtagagggccgaaatccgagcataggtcacaagtgtttgggtgccctgttcgactgcaaaaaggtaaaccacatctggacaaccaacttcgacgagctcatcgagaatgggattaaaagcgtcaacaatgccagcagcttcgaggtcattagtatcgacaatcagaggcagctggccaacctcaacaactacccaagggtggtaaaacttcacggcgactacaggtacgacaagctccaaaataccgttgacgaactgcagacgctggagaaggacctccataagtacttcgccgatgtgcaaagcaagaccggcttgattgtgataggctacggcggaaacgaccagagcatcatgtccgcctttgaaaagactttggaggccgacaacccgttcccgtttgggctttactggtgcgtgaggacgggccagaaaaccaacaagaaggtaatcgaattcatagagaaggttcaccagaagaacaaggaaaagcttgctgcgttcatcgaaatcgactcttttgacgattttctttatgagctgtataagacgaacaaccttgccaacgatcacattgaaaatatcgccaaaagccgcttcgaaaaaaggaaggcttttacagccccccagatcggcacctcctttacgcctataaagcttaacgccataaaggccaagacttacccgaaaagcatctattcctttaaaactgacctcaaggggggcaaggatgactgggataaactcagggaaatcattaaggaccaaccggtgagcgcggctctgaccaatgaaaacacggtcgccttcgcaagtgtcaacgacatcaagaaactcttctcacacacactgaagtcagagatcaccaccgtggacatagatgacaagttgatctatcggcaggagtctttctacctgggcatgctttacgatctgatagagcacaacctcctgaagaagttcaagttggagaaagtgcccaacaataggctccgcaagtattatagcaaaaactacaagctgaataccgaggagcttcagaagtccaagatcaagaccagcctgtccgtctacgaagcgttcgagattcaaatagaattccacaataaagagctgttcctcattatccttccgtccatccacatagacgacaaagccgggctgagccgatttgagaaacaggagatagccaataagatcataagcaaaaggtggaaccgcatggttaacaaccagcttaggttctggctggggctccttaagaacgataacactaacatagagttcagcatcgacagtttcaagattgatttggaagaaaagttctccggcgtcgggagctttacatcctcttactacatctttaagggcgcgtttatttccaacgaacccaagcttagcttccatatctccgacagcaattacaaaacagtgcaccccctgaaaggcctcaagaacttcggtccactggattactcatttgaaagcaaacagaccaatcagcaggctattaaacttggtataatcactccgatcagcggcatgcaacggatactcaaacacctgaacgaacttaataacgagatccgcgcagctacggaaaaggagtacctgaccgattattacccctttagcaacatctacaagagataccttgacatcccgcagaataaggatagtaaattcttggaactcgtgaatgaagccgaagtgaacaaactgaaccacctcgagttttatgacttcctcaaacgcaaaattgattacttctatacaattaggggcgagttcgacgtgcttgtgttgtattttcccaaaggctggactaagttccgcgagctgaaaaatgacagtgtctactttgatctgcacgactccatcaagctgtactgtgctaagaagaatatcaagatccaattcgtggaagataagagtatagactacctcgacccggccaaggttaaatggtggttgagcctcggcttgtatgtcaaagcgaacgggctgccctggcggaacgtggtcgtaaacgaaagcaccgcgtttgtcgggctcgacttcgcggtccagcgaataaacaacagtaacaagtacgtgctgggtagctcacagatcttcgacagctccggacaaggactcaggtttctgttgcagcccatcgaacaccctgtgtttatcggtaaaaaccccttcatgagcaaggaagatgcgcgacggatgattcttaaattgaaggaagcgtattttaggattgacggtaactccaagctggaaaaactggtggtgcacaaagtactgcattacacaaatgatgagatgaccggcatttccgaggcgctggaaggtattgagaacattgagcttctgcaaatacagaagtatagtaagtggagggcaattagaggggacatcgatcggtatacgggaaaggtgaagaccgacccgcacaatttcccgatccaacgggggacagtgatccagctcgacgacttctctttccttctgtggacacatggaagtgtacaggaagacgacgtggctggtaggcacatgaattactaccagggtaagcgcgggattcccgcaccacttctcatacggaggtttcgcggcaccgatccgattgaaatgaccgtgcgagacatcctgtcactcaccaagatgaactggaacggaggcgaactttacaagactctgccggtgaccctggatttctctaaacggctttctaagtatgcgaagcaggcagagaccctccaggcaataccctacgactttcggttcttcatgtagtaactcgaggttaacttgt

SEQ ID NO: 334 - DNA, 2375 bp, Artificial Sequence
  Description of Artificial Sequence: Synthetic polynucleotide
ggtgtcgtgaggatccatgccaaagaaaaaacgaaaagtagaagaccctaaaaagaagcggaaagtagggtcaggctctatgcttcaactgaacggctttagcatcgaaatcgccggaggttccctgactgtcttgaaatctaaaatcgcgcctaccgacgttaaagaaacccgcaggagcctggaagacgactggttcaccatgtatcacgagggccacttgtactcacttgcaaaaaacagcaacgcatccggcggattgggtgagaccgagctcctggtcctgtctgatcatctgggtcttaggttcgttaaggctatgttggaccaagccatgaggggcgtattcgaggcctacgaccccgttagagataggcccttcacatttctggcgcgaaacgtagatctcgtagccctcgcggcagaaaacctcgagtccaagcccagccttctctccaaattcgagatcaggcccaagtacgaactggaggccaaggtagtggaattcagaccgggcgagctggaacttatgctggcgctcaatctgactacacggtggatctgcaacgcctccgtagacgagctcattgagaagaacataccggtccgaggaatgcacctgatccgacggaaccgggagccgggacagagaagcttggttggcaccttcgaccgcatggaaggcgacaacgccctgctgcaggatgcttacgacggacaagacaagatagcagcctcacaggtgaggatcgaggggagcaaggaagtcttcgcgacctctctgaggaggctcttgggcaatcgctataccagtttcatgcactccgtggataacgagtacggcaagttgtgcgggggtttggggttcgacggcgaacttaggaagatgcagggatttctcgcgaaaaagagtcctatacaactgcacggaggtgtagaagtgtccgtggggcagagggtacaacttaccaatcagcctgggtataagacaacagttgagcttttgcagtcaaagtactgctttgacagaagtaggacgaagctccacccctacgcctgggacgggcttgctcgattcggcccattcgacaggggcagcttcccgacgcgatcccccaggattctgctcgtgacacccgactccgcgagcggtaaggtctctcaagctctgaagaaattccgcgacgggttcggcagcagccagagcagcatgtatgacggcttcctcgacacctttcacctcagtaatgctcctttcttcccccttcccgtgaagctggacggcgtgcagcgcagcgacgtgggcaaagcttatcgaaaggcgatcgaagataaactcgcacgagacgacgacttcgacgccgcctttaacattctcctggacgagcacgccaatctgccggacagccataacccctatctggtcgccaagtccatcctcctctcccacggcatcccagtgcaagaagcacgagtgagcactctgacggccaacgaatacagcctgcaacacaccttcaggaatgtcgccacagccctgtacgccaaaatgggtggtgtcccatggaccgttgaccacggggagaccgtggacgatgagctggtagtaggaatcggaaacgcggagcttagcgggagcaggttcgagaaaagacagaggcacatcggaatcacgacagtgtttaggggggacggcaactacctgcttagcaacctcagcaaagagtgccgatacgaggattacccggacgtactccgggagagtaccatcgccgtgttgagggaggttaagcaaaggaacaattggttgccgggtcaaaccgtgcgaatcgttttccacgccttcaagcctctgaaaaacgtggagattgccgacatcatcgcgagctctgtaaaggaggtaggctccgaacagaccatagaatttgcattcttgaatgtttccctcgaccactccttcacccttctggacatggctcaaaggggaataacgaagaagaatcagaccaaggggatatacgttcccaggaggggcatgacagtccaggttgggcgctacaccaggcttgtaaccagcatcggtccgcacatggtaaaaagggcaaaccttgccctcccgcgacccctgttgattcacctgcacaagcagagcacctatcgggacctgagctatctgagcgaacaggttctgaactttaccaccctgtcctggaggagcaccctccccagcgagaagcctgttaccattctctactcatcactgatagccgacttgttgggaaggctcaagtcagtggatgattggagccccgcagtgttgaataccaaactgaggaatagcaaatggttcctgtagtaactcgaggttaacttgt

SEQ ID NO: 335 - DNA, 3152 bp, Artificial Sequence
  Description of Artificial Sequence: Synthetic polynucleotide
ggtgtcgtgaggatccatgccaaagaagaagagaaaggttgaggatcccaagaaaaagcggaaggtcggcagtggcagcctgggagccggtgccagcatcagttccggcatccaaagcgctaatgactgcatttgggactggaagtactctatctaccaaactaactccggcagtcaacgagtggccctcgtggaccctaagaaatccgacgcctccaagtctatcatccagaagtggctggataatcaaccgaaattctcacagatcgaagcccatcaggagtacagcttctacgcccaggcggcttaccccattgaggcggaccgaatcaaatactttcagaatctcttccaggggaagtccccctatatcggctacaaattgctctgcctgctgaacaagtacggtgtagtgaaatctgtgtggagtaccaacttcgacggcctggtcgaacgggcagcacagcaagccaacatcaccctgatcgccatcaatcttgactgtgttgaccgcatatatcgagcagaaagcgtgaatgaacttctgtatatcgcgctccacggggactacaagtttagtaccataaagaataccgcgaatgagctcgacagccagcacaccgagttcgtatctgccatgtgccggtacttcgtcgataaaaacttgatcgtcatgggatacagcggacgcgacaagtcacttatggacgccctggtccaagcgtttagcaagaagggtggggggagactttattggtgcggcatgggcgagaccatcacgatcgaggtgcaaaacctgatacagagagtgaggaccgcaggccggtcagcttattatgtagatacctctgggtttgacaacaccatgctgtcactggtaaagtactgtttttcagaggacgtcgccaaacagcgagaaataaacgaaattttgaaaattgtggaaccggagcagattactccgtttgagattcaaaagagccagaacaaacggtatctcaagagcaacctgctgccaatcgtgcttcccaaggaactctttcagtttcagatctcttataacgacacggcggacaggtggggattcttgcgcgagaggattaaggagcgggaaatcatagcagtcccgtaccaggacaaagtatacgcaatcagcacggtctccatcattaacgacgttttcaaggactgtctcgtaagcgagattgagcgcacgtccatctctctgaatgagatcgagcgcaatggctgcttcaaagagctgttcctcaaggctattctctacgggtttagccaaatccggaatctgggcatcaactaccgccacggcatcatttggaagaaggaggcgctctacactgagcccggcaagaccgtacacgaggccatagaatgcggcttgtcttttataccgcaagcgaactacgctttgattagcatcacaccaagtttgcacatcgaatccagcagcccgatcgaaaaagagaagaaacaagagtataacaggcggtaccttgacaagatgaggaataaagagtacgaggaaaagatccaggagtggtgcaacatactgttctccggtaacaagctcgtttttgacatcccgctgcaaagcaacaacgacttgaagttcttcatttccagtaataggggtttcgccgaggtatacaattacggtaaggacatcgagaagagctacacgcccaatgcttacaatacgaaacagaccatttactacggcatgcaaatcgaagagcctcagttggagtttatcaactccataatcagtaggccgttctatgacgttaacccaatgaggggcctctcaaatcacaaaccattcgacgcggactactatgacaagttcccccaggatgtgtgtttgggcattgtgtgtccgaccagctacagcctgatgttctcagaattcctgaagcgcctgaacactaagatcccagcaccgaagtcatccgactacatccacaactatattggctttaacagcatctacaactgcaggctggacataccggacatcaatgccgatcgctgggtgagcatcggcgacaacccccagaacgcggaggaattggcccgcaacatctgtatggaagcaaaaaagctgagtgaacaatatccgggcatcgtggttaacatattcatccctactatctggagcaactacagaaactttaaacacaacggtgaattcttcgacctgcataactacattaaagcatttgcggcacaaaatcgcttcaccacgcaactcatcgaggagaaaactgtttgtaacacgatgatgtgcgagatatcctggtggctttcccttgcccttttcgttaagaccctgaggactccgtggacactggctgaccttaaccccaacaccgcctacgcggggatagggtattcagttaaaaagcaggccaagggcaggacagagatcgtactggggtgtagccacatttacaatgcgcagggacagggactcaagtacaaactgagcaaggtcgagcacccacagttcgacaaaaaacggaacccattcttgagcttcgaggaagccttcaaattcgggatggatattcttaatttgttccagagtgcaatggaaaaactgccgcagagggtggttattcataaacggacgccttttagggaagaggaaatagaagggattaccagcgccctcaagcgggcagggatcacggaggtggacctgatcactataacgcaggagcgaaacattaagtttatagcacaggttgtctccttcggccaactcaataccgacggctatcccgtcaacagaggcacttgcatcaagcttagctctcgcaatgcactcctttggacccacggcgtcgtccagagcattcgagacaaaagacggtactaccaggggggcaggtgcattccgagcccgctgaaaatcactaagtattacggcaacggcgatctccagactatagctaaggagatcatcggtttcacgaagatgaattggaatagcttcaacttctatacgaagctgccagcgaccattgacactagcaacaccctggcccaagtgggcaaccttctcaggaactataatggcaccacctacgattatcgctactttatctagtaactcgaggttaacttgt

SEQ ID NO: 336 - DNA, 2198 bp, Artificial Sequence
  Description of Artificial Sequence: Synthetic polynucleotide
ggtgtcgtgaggatccatgccgaaaaagaagcggaaagtagaggacccgaagaaaaaacgcaaggtgggctccgggtctatggccaaccatacctttaacatcctgactttcaaccacccccaggaggaacagaccttctacttcacggaccaggagcaagacaacctgacccgcatctacaagagcctggtgcccgacgaggtcatcgagaaatatggcgagcaggatcactactacacctctttcaccgtagagaaggatggtttcctggccgtcagcaagcccacaacgcccctgttcgagaccaagactacggaggcgggcgaggagaggagctataccatcaggaattcaacgttcagcagcagcgtgttgaaacggtactacaacagccttatccacagccacttcaaggagaagggcttcctggtgaagcccaacttcgtgagcgacacggaggtgtggctgcctagcgccaagcaggacacgaccggcaaatacaaaatattcgaccgctttagcctgaaggtgcagttcaagaccgtctctgattccctggagttgctcgtcacgttcgaggggaagtcaaagatattcaaagtacctgttagcaccctgctggaggatgtgagccccacggacatcaactgggttgtgtacgaaaagggattgtacaggttcgacgaactcccggacagcggcaagagggagtatgacaaggtttaccccgtgtggaccttcgagatcagggacgcgcttatgcagggcaccgaagccccagacaagaccaacaagtacaaaaagttcagggagggcatcgacaagttctataaccagtatctgaacacagaggagttcaaagccatcattccaatcacgtctaatggcttcatcccggtcaataagatcaatgtcggtagtgtgaataatagtagcaacaggctgctgttcggggaacaaaagagcggtatcgtgccaatggacggcatgaaggaacatggcccattcgacttttccagcaccagcaagatccatttcttctttatctttcataaagacgaccagcacatcgcccaaaagatggatggctatttcaaaggcagcgagttcgggttcaagggactcaccaaattcatacacaccccctatcacaccgagaaaggattctcaatcaggtttgaggaccgcgacaatccgtggcccgagatctacgaagccgtcactaacaagcacttcgagtccgacatacaatacattgcgatctacatcagccccttcagcaaaaacagccccgacaagagtcggcgcaaaatctattacaagctcaaagaactgctcttgaaagaaggcgtgagcagccaggtgattgacggcgagaaggtgatgaccaacgagaagtattactacagcctccccaacatagcaatcgccattctggccaagttgaatggcaccccttggaaactggacaccaagctgaagaacgaactgatcgtgggaatcggcgccttccgcaacagcgaggttgacattcaatatatcggcagcgcgttctctttcgcaaacaacggcaagtttaatcgctttgagtgcttccagaaggaccagacgaaagaattggcgggaagcatcatacgggcggtgaaggagtacgccaacgtaaacaccggcattaagaggcttgtgatccacttttacaaaagcatgcgacaggatgagctccagccgatcgaggacggccttaaagacctcggcctggacattccggtattcatcgtatctatcaataaaacagaaagcagtgatatcgtggcgttcgataacagctggaaggatctgatgccgatgagcggcacattcattaaagtggggtacaacaaatttctcctgttcaacaacaccaggtataatccaaagttttacagcttccacgacgggttccccttccccatcaaacttaagattttttgcactgaaaaggaactcgtggaggagtataaaacggttaaagagctgatcgaccaggtgtaccaatttagccgcatgtactggaagtctgtccgccagcagaacctgcccgtgaccattaagtatccggaaatggtggccgaaatgttgcctcactttgacgggaatgagatacctgaattcggtaaggacaacttgtggttcctgtagtaactcgaggttaacttgt

SEQ ID NO: 337 - DNA, 2231 bp, Artificial Sequence; identical to SEQ ID NO: 285
  Description of Artificial Sequence: Synthetic polynucleotide

SEQ ID NO: 338 - DNA, 2318 bp, Artificial Sequence
  Description of Artificial Sequence: Synthetic polynucleotide
ggtgtcgtgaggatccatgcccaaaaagaaacgaaaggtagaagatcccaagaaaaaaaggaaagtgggaagcggaagcatggagaacctggctcttagtgcgctgcaactggactctaagctcgaccgctacatcgtgtgcaggtacagaatcgtgtaccagaagcgagacgagaccattcccggcgaacagttggcccggaaggcggcctacgagatccagaaagcgaatgacttcgcccttttgaccaacctcggcaatcaacacatcgtttccctcaagcccatctcacagaggggcattgaaagcacccaccttcaggcgaatctcatcgaagacggggacctggagctcgattgctccatcgaacaacatcagcaggcactccagcggctcgtgaaccaggacatcaataaagctgcgtggaagcttaagaagagctcacagggcaaactcgattacaaaaaggcagctagcgggaacaccgagatctttgagccaattcatagcactcgaatcaacgcccgagccacgtatcttgacgctttttgctcactgcagcttagccccgaggtgcttgctaatggaaccgtactgatagggctgcatctcaagcacaatctggtagcaaagtctgacatctctttgcagtggatcattgataaaaggcccgattggctgcagagcatcaagaaggtgcggcacaggtacttcgatcccggcaaagcgcccctggtcgccgaattcctgagggtggaggactccctgaatggcaacagcgtcttgccccacatgggccagagtcttgtttcataccaccaagcgaagggactcttgtcagaaagacagctcgcagaggccacgaagagcgtgctgataaaggtaaaatacggcaaaaacgaggcggaccacatcgcatctctggttgaaccaatgtttgatttcgacacgctcagcaagatcgatagtatcttccttaacaagttggcaaaggacctgaagtggagcctgaacgacaggatacgcacttccgcgaaaatggtgaaaggcttgtatctcccaaacttcaactgcaagctggaacaggttgactatcagatccttcacaggcagcgacttaatcaccaacagatgcttcaattcgccaacggggcgaaatcttcaagagagcaggacgtgctgcgacataaggcgttcggcaacatgacgcgcacacaagttatcccgcttattgcgggcgagaagaacaatacagaacaaaataagcagctcctgtgcaacgcataccaagcattgcaacaactgaccaccacggaattgcctccgttcaccaagttccccaaccccgtagagaacgcagccgagctggacgcaagactgaatgaacggtgtcccccaaatgcgatactgctcatcggccttatcgacaaaagcgacaaagtggcgatccgcgacaccgcgtttagctacggtcttgcaacccagttcatgcgcctggatcacagaccgaacgtctacagcccctcatatttcaacaacgtggcggctggtttgttttccaaaggtggcgggcagctctgcgccattgatgacatgccgggtgaaaccgacttgtttatcggtctcgacatgggagggatctctgtaagggcaccaggcttcgcgtttctgtttctgcgatctggtgcgcagttggggtggcaactcgcggacaaacaacagggagaaaggatgcaggatgaggccctgatgtcactgttggacaagtctctcaccacctacctgagaagctgctctggtgagcttcctaagcgcataaccctccatagggatggcaagttctacgaaagcatagaagtgatcgagcagtttgagcagaagcacggcgtgaaagtagatgtgctggaggttctgaaaagcggtgctccggttttgtatagacgaagccgcatggccgacggaaccaaggagtttagcaaccccaatgtgggcgacgcgatctatctcagtgatcatgagatgatcctgagcacgtatagcggcgaagaactcggaaagatatggggtgacaaggtcagcgtcaggcctcttaggctgcgcaagagatacggtgatgtgagcctggagaccctggcacatcaagtgctcgtgctgtctaggatacacggcgctagcctgtatcgccatcctcgactgcccgtgaccacgcaccacgccgaccgattcgcaacactgaggcaggaaacatgcatagacgccctctctaagatggaccggctctgtccggtctacctgtagtaactcgaggttaacttgt

SEQ ID NO: 339 - DNA, 2390 bp, Artificial Sequence
  Description of Artificial Sequence: Synthetic polynucleotide
ggtgtcgtgaggatccatgcctaagaaaaagcgcaaggttgaggacccgaaaaagaagaggaaggtcggcagcgggagcatgcagctgaactacttccccataaagtttgagtttgaagagtaccagataaaaactgagccctacagcgaagaacgacttaaagagttgagggccagttacaacgccacccactccttttttagaaatggagacaatatatgcattagcaacaaggaaggcgaggacattagtctgaccggcgaggtgataccgaaaagaattttcgacgacagtcaagtgaccgcctcattgataaagcacttgtttttcaggacgttcaaggagaggttccccaactatattcctgtggacttttaccccttccgcttcttctccgcccaggctaaagacgacatcatctataacgccctgcccggcaacctccggaaacgaatcgcttacaaaaagctgatcgaggttcagttgcggctgacggaaataaacggcatcaagcagtttggcttcctgatcaacattaaacgaaattgggtgttcaacaagtcatgcttcgagctccactccgagggctacaacctgatcggggtggacgtgctgtacgccgaggaactgccggggttgaccgaggtgctggccccaaacgaagagcttttgggcgtaatcgcggaaatcgtggacgacaatgccaggatagaaaccaacgagggcattaaggagttccctctgaaccagttgttcatcaagaaaagcaagtacaacattggcaattaccttagcttcgcgatctctcagcaaaagagcgacgaaataatgaatcttatcgagagcaaacgctccgacatctacaataccaagggtctttacgacgagatcttgaaaattgcgaaccatcttttttgcgagaacagcgcacccatactgtttcataataaggacggattctgctttactgtcgattcccagccgctcagtgtgacgaacagcatggaattgaagactccaacattcatatacgatccagcggccacgaagacgaattctagcaatcccgacttgggcctgtccaattacgggccctacgactccagcatttttgacataaagatacccaacgtgttgtgcatctgcaataggaataatcgaggcaactttacaaagtttctgtctaacctgaaagacgggatacctcaaagccgctatttccagaaaggcctccagaagaaatacgacctccaggatgtgatcctcaatatccgagaaatccaggcctatagcatcgccgactaccttaacgccatcagggactacgatgagaacaagcctcatctggcgatcatcgagatccctgccagcttcaagaggcaggccgacgtggcgaacccctactaccaaattaaggccaagttgttgagcctggagattcccgtgcaattcgttaccagcgagaccatcggtaaccacaacgagtatatcctgaactctatcgcgctgcagatctacgcaaagctcggcgggaccccgtgggtcctgccctctcaacgcagcgttgacaaagagataatcatcggaataggccattcctggcttaggcgcaaccagtacgctggcgcagaacagaatagggtagtggggatcacgacctttatgagctccgatggccagtaccttctgggtgacaaggtcaaagatgttgccttcgagaactattttgaggagcttctgaaaagcctgaagcaaagcatccagaggctcagcacagagcagggctggagcgatggcgacaccgtgaggctgatattccacatattcaaaccgataaagaacactgaattcgacgtgatcagtcagcttgtcagagacatcacgcagtacaagattaagttcgcattcgtaaccatcagcactgtgcacccttccatgttgttcgacattaatcagtccggtatcgccaaatacggttccaatatcatgaagggacaatacataccaaacaggggcagcaacgttttcctggacgagaagacatgcatcgtacagatgttcggcgcgaacgaactgaaaacggccaagcaaggcatgagcaagcccatccttataaacattcgcaccccccaggggaactacaattcaagcgacctgaacgatctcctgttttatgacctggggtacatcacacaacagatatttagctttacctacctcagctggcggtccttcttgcccggtgaagagccggcgactatgaagtacagtaacctcatttccaaacttctcgggaagatgcggaacatccctaactgggacgccgacaatcttaactacggcctgaaacggaaaaagtggttcctgtagtaactcgaggttaacttgt

SEQ ID NO: 340 - DNA, 2123 bp, Artificial Sequence
  Description of Artificial Sequence: Synthetic polynucleotide
ggtgtcgtgaggatccatgcccaagaaaaagcgaaaggtagaggaccccaaaaagaaacgcaaagtgggctccggaagcctgaagctgaaccacttcccccttaatcccgacctccccctgtacatcacagaatatgcccaccggaacccgcgagcgttgctcggattcgttaggggccaaggtttctgggcgcaacaggtcggagaacaggtacaagtgtaccacggtagaccgcagcccacgttcaggggagttcaggtgatcagccataccaggttggaccccgaccatccggcttttgaccaaggcgttttgagcctcatccgacaagcactggtgagggcgggatacgtgctgacctacagggagaggatggctattcatcccagactggagagggttgtgctgagacccccggaccggcacccagcagagttgaccgtccatgcacatctgcgatgggaatgggagcttgaaaggcacagcggacaacgctggctggttcttcgacccggcaggcgacatctgagcgcccttccatggcccgcagaagcagtacaaatgtggtccgccgctcttccggccacctgccagaagctgcacgccctttgtctggaccgaggccaacagatggcccttttgcggcaagaggacggctggcacttcgccaatcccggtgctgccactcaaggaaggtggcacctgtcctttagcccccaggcccttcacgagctgggactggcacaggctgcgcaccatgcggctgcatttaggtgggacgaggtacagcgactcgtgcaactgactgacctgtggaagcccttcgtgacctctctggagccccttgaggtagctgcccccatcattgccgggaaaaggctgaggtttggacggggtcttggccgcgatgtcacggaggtgcacaagcgaggtatcctggaaccacccccactgcccgtgcgactggctgtcgtgtctccccatcttcctgatgagcacgcgaacgcccagttgaggcgggagttgcttgctcacctcctcccgcgacaccaagtactgagatcagcggagagccggcaaggcctccacgagcacctgaggaggcaagatcaggacgataccctgtataccttttggtcaggcggcgagtacaggaagctgggcttgccccccttcgatctcgcacgaggcctgcacacctacgacccagctagcggccagctgcaacaaccggctgccctggcaccagcacccgcgcaggccacgcaagcgggtaggcagctgatagccctggtggtgttgcccgacgacctgacgcggtctgtccgggacaccctgtttcagcagctccagcagttgggccttaggtgtctgtttagtgtgagcaggaccctgctgcaccgaccacgcacagagtatatggcatgggtaaacatggccgtcaagttggctaggactgcaggggccgtgccttgggacctggcagacctgcccggtgtcaccgagcagacgtttttcgtaggcgttgatctggggcatgaccacacccaccaacagtccctcccggccttcaccctgcacgaccataggggacgccctcttcaaagctggacgcctccccgacgcaccaataatgagaggctgtcattggccgagcttaagaaggggttgcataggcttcttgcacgcaggagcgtggaccaagtgatcgtgcatcgagacggccgattccttgctggcgaggtggacgacttcactctggcgttgcatgatctcggcatcccgcagtttagcttgttggcaatcaaaaaaagcaaccacagcgtggcggtgcaagcagaggaaggatccgtgcttagcctggacgaacgacgatgccttcttgttactaatacccaagccgcgcttccgcggcccacggagttggaactggtccatagcgacaggcttagtttggcgaccctgaccgaacaagtattctggctgacccgcgtcttcatgaacaacgcgcagcatgcgggcagcgatccagccaccatcgaatgggccaacggcatagccaggactggacagcgagtgcccctggccgggtggcggctgtagtaactcgaggttaacttgt

SEQ ID NO: 341 - DNA, 2291 bp, Artificial Sequence
  Description of Artificial Sequence: Synthetic polynucleotide
ggtgtcgtgaggatccatgcccaagaaaaagaggaaggtcgaagatcctaaaaagaaaaggaaagtcgggtccggtagcatgcccacccagttccaggaggtggaagtgatactcaaccgcttctttgtaaagaaactgtctcggcccgaccttacgttccatgagtaccaatgccagttcacccaggttccagagcaaggcagcgaacaaaaggccatcagcagcgtgtgctacaagctcggtgtgaccgccgtgaggctgggctcatgcatcatcaccagggagcccatagaccctgaaaggatgcgcaccaaagattggcagttgcagctgatcggatgccgagagctgagctgccaaaactaccgagagaggcaagctttggagactttcgagcgaaaaatcctggaggaaaagctcaaggaaacatttaagaagaccatcatcgagaaggactacgagttgggcctgatctggtggatatcaggcgaagagggactggaaaaaaccggtcacgggtgggaagtgcacaggggcaggcaaatagacctcaagatcgagacggacgaaaagttgtacctggagatcgacatacatcacaggttctacacccccttcaagctggagtggtggctgagcgaataccccaacatccaaatcaagtacgtgcgcaacacgtacaaggacaagaagaaatggatactggagaatttcgccgacaagagccccaacgagattcagatagaggcccttggcatcagccttgcggaataccaccggcaagaaggtgctacccagcaggaaatcgacgagagtagggttgtgatcgtcaaaaagatctctgactacaaggcgaaacccgtgtatcacctgtctcagaggctgtccccgatactgaccatggagacccttgcccagatcgccgagcagggtcgggaaaagaaggagatacagggcgtgttcgattacattaggaagaacatcggcacgaggctgcaggagagccagaagatcgcgcaggtcattttcaagaatgtttataaccttagcagccagcccgagatcatgaaggtgaacggttttgtaatgccacgcgcgaagttgttggcaaggaacaataaggaggtcaaccagaccgctaggatcaagagtttcggctgcgctaagatcggagaaacgaagttcggatgtctcaatctgttcgacaacaaaccggagtacccggaggaggtacacaagtgcttgctggcgattgcgcggagcagtggggtccagataaagatagatagctacttcacggggagcgactacccgaaagatgacttggcccagcaaaggttctggcaacagtgggcggcacaaggaataaagacggtgctggtcgtgatgccctggtcccctcacgaggagaagacaagactgcggatccaagctcttaaagccggcatcgcaactcaatttatgatccccacgccccaggataacccatacaaagcattgaacgttgctttgggtctgctctgcaaagccaaatggcaacccgtttacctgaagcccctggatgacccccaggccgcagacctgatcatcggcttcgacacttctaccaacaggcggctctactacggtacaagcgccttcgcgattctggcgaacggccagtcactgggctgggagttgcctgacatccagaggggcgagacatttagcggccaaagtatatggcaggtagtgagcaaacttgtgctgaaattccaagacaactacgacagctaccctaagaaaattctgcttatgagggatggactggttcaagacggcgagtttgaacagaccataagagagttgacccaccaagggatcgacgtggacatcctgagcgtgaggaagagcggtagtggcaggatgggaagagaactgacaagcggcaatactgccatcacctatgacgacgccgaagtgggaaccgtgatattctattctgccaccgactcattcatactgcagacaaccgaggtaattaagacaaaaacgggcccactcggttccgcgcgaccgctcagagtggttaggcactacgggaacaccccgcttgaactgctcgcgctgcaaacgtaccacctgacccaattgcatcccgccagcggctttcggagctgtaggctcccctgggttctgcacttggcagacaggagcagcaaggagttccaacggatcggtcaaatttcattgctccagaacgtggatagggagaagctgattgcagtgtagtaactcgaggttaacttgt

SEQ ID NO: 342 - DNA, 3143 bp, Artificial Sequence
  Description of Artificial Sequence: Synthetic polynucleotide
ggtgtcgtgaggatccatgcctaagaaaaaaagaaaagtcgaggatcccaagaagaagcggaaggtggggtccgggtctatgctcacacaagaacaatttatacgcaactttagcgttatggccaatggtgaagtagacttctttcttggtgccggtgcatctattgcgagtggaatcccaactgggggtggcttgatttgggaatttaagaggacactgtactgtagcgagtgcggcatcagcgccgaaaagtacaaggacctgtcactcccaagcacgcgcaaaacgctccaggactacttcgacattaaagggtattgccccaaacaatatgcgcctgaggaatacagcttctatttcgagcaatgttacaccgatcccatggcccgaaagaggttcatcgagaatatggttagtgggagggagccaagtataggttacctttgtctcgcggaggccgttatgcaaggcaaagttaaaaacatttggactaccaacttcgatagccttctggagaatgccctccataggctttaccccatgaacaacgttttggtgtgctccgaggctaatagaggcagtgtgtgcctgctcaacccgacgtacccagtcataggcaagctccacggcgactatcgctatgattggctcaggaacaccgaggacgaattgcagcgactcgagaccagccttaaaggttacgcgtccagccaacttacagggaaacaactcgtcgttataggatatagcgggaacgatgagagcattatcagtttcctcaaggattgcatagataacccggcactgcttaccaagggtctgctgtgggctgtacgacgcggttcctgggtaaacccgagggttaatgagctgatagaacgggcgcacaaaattgggaaaccagccgacgtgatcgagatcgatggcttcgaccaattgatgttctcaatataccagatccagaactaccataatgagattatcgacggccaaggcaggctcctccaggtcggatctgacatccgcctcacggggaagcccgtggacagctttgtcaagctgaacgcttacaaggctgagtactgccccctttgtaacgtgttcgagacagacatcacatcctggaaggaacttcggaccataaccggcagcagtgacatcatcgccggtctgttctccaaacatatctattctctgtcttccgcagacaaattgaagaccgtgttcagcaagcactttctctctagcattaacaaggaggaggctcccgaacgggacattcgacggaacgagagtgtgtacattggattgatttaccagcttattaagcggaccctgctttcaaaagggatggtgtccttcgctaagaataaggtctataaccccgacagctgccgcagcgagcaaggctaccaagtttttgacgccctggagatcgcggtcagcttcgttgatggaaacctgtacctgaatcttatgcccacggtacatgtgagaggctcaaatggcgagagtctcgacaaagagtcctaccaaatacaagtcaaccatgtggtcagcacaatctacaataagcaatacaatgagaaactgcggttctgggagagcttgtgtctggacagtggtagaataatcttcgagaacgacggcttcagcatatcatttgtcgctcccgctgtctccctgggcggcaacaatcgaagagctaagtggctttccatgccgtcctgcaagtatgacgaaccactcatgtgcttctcagacactgacaaaagcaaacgagttattaaccaactgaagggactctgccagtacgggccaatcgactgctcttatatgcgggatagcaccacaaggcccagcgttaggctggccgttctgagcccgaaccaggacatggaccgaattcttgcacacctcaataaactcaacacccacgtccaaaacaggggcagcgataatttcctgccccactatgagggctttgagcaagtttacagaagggctctgagcgtccctacgaaggagcagagcaacatctgcatcggatacaacgtgaacgccatcctcaaaatgtctcctgcagagtttctggcttttatgaagcggggtatagagaaatactcccttcggtcaagcgatttcgatatactcgttatttacatcccagagtcattcgcgcatttccggacagcaaccgaaattagtagcgactacaatctgcacgatgcgctcaaactgtatgccacggataaggggattatccttcaactcatagaggagaaatctgtgaagtcatacgacccctgcaaagtaatgtggggcttgtccacctcactctacgcgaaggcgacaggggtactttggcatccagaggcaattagaaatgacacggcctacatagggataagctacgctttcagcgaagagaaaaggatttgtataggctgcagtcagctgttcgactcaaccgggacaggtattcggatggtccttagaaagataaacaatccgatatttctggggcgatccaacccctacatgagggaagacgacgctcgaattatgatgaccgagctcagggagcagtattaccacagcgcacctgtgaatactctcaagagggtcgtgatccataagaccacgcccttcatacgggatgagatagccggtataatgcaggcatttaacggcatcgaggtcgagctggttcagattcaagactattgctcttggagaggcatacgcttcggcggtgagcctgggaaaacggcgtttgggttcccggtgaagcgaggtatggccgtaaaactcgaccgagaaagcttcctgctctggacccacggctgcgtgattcacccggaactgtcaggcacgcataactatttcaaaggttcacgcggtatcccagcacccctcctggtccgcaggtttgcgggtaacgcaagtggcgacacattggcaaaagagattctgatgcttacgaagatgaactggaactccggtgacagtctgtacaaaacccttcccgtgaccctggattttgcgaaagttctcgcccgcatgtctaagcaagatgaggcgatctttgataaggcgtacgacttcaggtttttcatgtagtaactcgaggttaacttgt

SEQ ID NO: 343 - DNA, 2462 bp, Artificial Sequence
  Description of Artificial Sequence: Synthetic polynucleotide
ggtgtcgtgaggatccatgcccaaaaagaagagaaaggtggaagatcccaagaaaaagaggaaggtgggtagcgggagcatgagggaaaccaacatctacgagctcagcggcctcgaaaccgtgagtaccagctacagacttttcgagttgcagggcgcgccagagttctctcctgagtattatgctggtgtgagccgcctcgtgaggacgcttagcaggagacaccaggcacccttcaccagtatccaacggggcgagaccatgttgctcgctgcacccgaggccctgagcggtgatctcgcagaacaccataatctggcacgctgggtggcgaccctgaagtcacttggagatagcatagagatagactgcagcgtgagcggagatgagctggaccccataaggctgcgattcctgaacttcatgatccaatctccattgttcaaccacggcgagctctggcagcccagggccggtgatgccttctactaccggaagcctgccgacacgttcgacggaatcgaactgtttgagggtattgccgtgagggccgtgccctacccaggaggcgggttcggcgttatgctcgacgcgaggactaagctgatctcacagcgggctgtgggcgcctacgcggacccgaatttcataaggaggctgaaaaacactagctgcctgtaccgaatgggagacatctggtacgagataaagatcagtggcgcgaatcagaccgtttctcaccccatcctgtttaaggacaaccagcccgtgtcactcaaagcctacctgcacgaacaagcacggcagccaatccccaagtctctgattgatcttaaaggtgacggcgtggtgttgacctatcgcggcagcgatagcgccgaggtcaaagcggcacccgcggaactttgtttccccatagtagacacccatagcaagaggggtgcccggcaccagagaaggagcatccaagccccacacatccgacgcagcaaggcttaccgattcaagcaaaggttcttgcgggacatcaaaataggaaatgccgtgttgagcgtggccgaccaacccgcagccctcaagaccaggcccatcgacttgcccgagctgcaattcggctccaataggattctgtacggcacggacaggggcggagaccgaatcgaccttcgccagtatgccaagaatcggcgaacgctgctggagcgcgcagacgtgggcttctttgagacttctcccctggagccccaatgtttggtacttcctaagagcgtgatgaacgcatggggcaacgagttcgttcgagacctgactgccgaagtgaagcgactccaccccaccggtaactacaagccaaccgtaatcgcgtttgatgatgtcagcgcaaccgtggacgccaggagccaagcagaagccatcttcaagctcgcggaagacggggatctccctccaggcgactgcgccattatgatacaccgaaccaaaggaaaggcaagagcgcaggaggagctgcccgcacttcttataaacaagctgagaaagagctacggagtgaatgccgccatattccacgcgactgtccccggcaacgcctaccgaagggaaagcgccagcgatggcgctcgctatgtgcgcaagcgggatgagaagggcaggtttagtggatacctgaccggagcggcgcttaacaagattcttctgcccaacgccaagtggcccttcgtgctcaaggacgagttggtggcagatatagtggtgggcatagatgtgaaacatcacaccgcagctctcgttttgatcgccgaaggcgggaggattatcaggcacactcttcgcctcagcaccaagaacgagaaactccctgctggtatcgtggaaacgaagctggtggaactgatttcaaatgaagcaccacacctgagcaggctcaccaaaacaatcgccatccatagggacggcaggatttggccctccgagcttaagggattgcgagcagcctgtaggaagcttgccgacgacggccacatcgatcctgcgttcgatctgaacgtcttcgaggtgagcaaaagtgcccctgctaggcttaggctgtttagcgtcgaccgcagtgctggcagaaagccgaggattgaaaacccggaactgggggactggatgatgctgacagaaaccgacggctacgtttgcacgaccggtgctccgctgttgagaggtggtgcggctagacccctgcatgtaaagcaggtcgcaggtgatatgagcttgcaggacgccctttccgacgtgttccgactgagctgtctgacctggactaggcccgagtcatgtagcaggttgcctatcagtttgaagctctgcgatatgctgctgatggacgagggaactgcccacgacgaggacgaaatccttcatgctaacgacgacaccccagccgttagcgcctagtaactcgaggttaacttgt

SEQ ID NO: 344 - DNA, 2402 bp, Artificial Sequence
  Description of Artificial Sequence: Synthetic polynucleotide
ggtgtcgtgaggatccatgcccaaaaagaagcgaaaagtagaggatccaaagaaaaagcggaaggtcgggagcggctccatggcgtttaggcccggtgaacgagtcagaccgcagctcgcgctgaatgcgatcagggtccttacaccccctggcaccatccccgccagtgtagtccaattcgacagagcgctgctgcacgcatatcttgacagacccgagaacgacgtattcgctacccgacacggggagactgatatggcggtcgtacccctgaccagcggtgcgaacctgccaacggacagaatggggcttccagctgcagagcacctcaggctggtatctgcgctgacaagagaagctgtgtttcgcctcctcgcggccagcccggaagcggatctgctgatccggcgacgcccaccgaccgtcgcggggaagagagaaaacgtacttgcagaggacattgggctcccggactggttgaagaaaagacttgtgctggagttcgacacgcgcatattgcaaccaccgagaggggacgcctacgtggtgctgacgtgtagtaaaaggctgcgcacgacaatagacgcgagttgtcgcacccttctggaactcggtgtaccactgacgggtgccgcagtcagctcctggagggaagatcctgaccccaaggtgagccggcgattggcctacgctgggcgcgttgtagaagtagggcaggacacgctcactctggacgaccacggagctggtccgagtgttgtctccagcgaagacgtgttcctcgagccgactcgagcaaacttcaacaaggtggtggaagtgataacccagggtaactccgaacgagccttcaaggccgtacaaaaagcagaagccgaatggcacggcgggaggcggacaatcgaaatagtgcatggtgtcctcaaccaactcggcaaccggtcaatggttcttgccgatggcgtgcctctgcggctcgggggcttgatagaccaagcggtcgatagcgacgcattccccccagccgaggcggtgtggcgccctaagctctcattcgaccccgtgcacagccccgagacatcaaattcctggaaacagcagtcactggacaggacgggccctttcgataggcaaacctttgaaacaaagagaccgcgaatcgcggttgtccatcaggccggaagaagggaggaagtggctgcggcgatgcgcgatttcctccacggaaggcctgacatcgccagcgatacgggcctggttccccacggttcaggactcctcggacgctttaggctccacgaacccgaagtgagatactttgaggccgcaggcagggggggacccgcttatgccgacgcagcacggagtgcgctcagggacgcggcgtcaagggacgaaccatgggacctcgcaatggtgcaggtagagcgggcgtggcaagatcgcccacatgccgatagcccgtactggatgagcaaggcaacgtttctcaagagggatgtgccggtgcaagcccttagcacagaaatgttgggtcttgatgcatttgggtacgcgaacgcacttgcgaacatgtcacttgcaacgtatgcgaaactgggcggtgccccgtggcttttgtttgccaggtcaccaaccgaccatgaactggtggtcgggctcggaagccacactgtaaaagagggccgaaggggtgcgggtgagaggtttgtcggtatcgcgaccgtattcagcagccagggccattatttcttggatgccaggacagccgcggtcccgtttgaagcctatcctgctgccttgagcgacagcatcgttgacgcgatcaaaaggattggacgagaggaagcctggcgaccaggcgaggccgtcaggttggtctttcacgccttcacccagttgagccgagaaaccgttcaggcagtggagagagcagtagcaggcatcggggccaccaacgtaagcttcgcgtttctgcacgttgtcgaagatcacccgtttaccatgtttgaccgagcgtggccagacggaaaggcgacattcgcccctgaaagaggtcaggcgcttcgactctccgagcgcgaatggttgttgacacttaccggcaggcgcgaagttaagagcgccagtcacgggctgcctgggccggttctgttgcgacttcatgacagcagcacctatagagacatgcccgtgctcgtccgacaagcatccgacttcgccttccactcttggcgcagttttggacccagcggactccccatcccgttggtttacgcggacgaaattgcaaaacagctcagcggcttggaaagaacccccggatgggacacggatgcggctgagggtggccgggttatgagaaagccttggtttctgtagtaactcgaggttaacttgt

SEQ ID NO: 345 - DNA, 21 bp, Artificial Sequence
  Description of Artificial Sequence: Synthetic oligonucleotide
gctgccatccagatcgttatc

SEQ ID NO: 346 - DNA, 20 bp, Artificial Sequence
  Description of Artificial Sequence: Synthetic oligonucleotide
gctgccatccagatcgttat

SEQ ID NO: 347 - DNA, 19 bp, Artificial Sequence
  Description of Artificial Sequence: Synthetic oligonucleotide
gctgccatccagatcgtta

SEQ ID NO: 348 - DNA, 18 bp, Artificial Sequence
  Description of Artificial Sequence: Synthetic oligonucleotide
gctgccatccagatcgtt

SEQ ID NO: 349 - DNA, 17 bp, Artificial Sequence
  Description of Artificial Sequence: Synthetic oligonucleotide
gctgccatccagatcgt

SEQ ID NO: 350 - DNA, 16 bp, Artificial Sequence
  Description of Artificial Sequence: Synthetic oligonucleotide
gctgccatccagatcg

SEQ ID NO: 351 - DNA, 15 bp, Artificial Sequence
  Description of Artificial Sequence: Synthetic oligonucleotide
gctgccatccagatc

SEQ ID NO: 352 - DNA, 14 bp, Artificial Sequence
  Description of Artificial Sequence: Synthetic oligonucleotide
gctgccatccagat

SEQ ID NO: 353 - DNA, 13 bp, Artificial Sequence
  Description of Artificial Sequence: Synthetic oligonucleotide
gctgccatccaga

SEQ ID NO: 354 - DNA, 981 bp, Artificial Sequence
  Description of Artificial Sequence: Synthetic polynucleotide
tcaagcctcagacagtggttcaaagtttttttcttccatttcaggtgtcgtgacgccaccatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaataactgtgccttctagttgccagccatctgtccccatgggcgataacgatctgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 355 - DNA, 813 bp, Artificial Sequence
  Description of Artificial Sequence: Synthetic polynucleotide
gaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcat

SEQ ID NO: 356 - DNA, 5251 bp, Artificial Sequence
  Description of Artificial Sequence: Synthetic polynucleotide
agcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttacagttaattaaagggaacaaaagctggcatgtaccgttcgtatagcatacattatacgaacggtacgctccaattcgccctttaattaactgttccaactttcaccataatgaaataagatcactaccgggcgtattttttgagttgtcgagattttcaggagctaaggaagctaaaatggagaaaaaaatcactggatataccaccgagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtaccgggccccccctcgaggtcgacggtatcgataagcttgatatccactgtggaattcgccctttcaagcctcagacagtggttcaaagtttttttcttccatttcaggtgtcgtgacgccaccatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaataactgtgccttctagttgccagccatctgtccccatgggcgataacgatctgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcaagggcgaattccacattgggctgcagcccgggggatccactagttctagagcggccgcaccgcgggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgattaaattttggtcatgagattatcaaaaaggatcttcacctagatccttttaaattaaaaatgaagttttaaatcaatctaaagtatatatgagtaaacttggtctgacagtcagaagaactcgtcaagaaggcgatagaaggcgatgcgctgcgaatcgggagcggcgataccgtaaagcacgaggaagcggtcagcccattcgccgccaagttcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgttcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcattagtgtccttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccaccttaatcgcccttcccaacagttgcgc

SEQ ID NO: 357 - DNA, 90 bp, Artificial Sequence
  Description of Artificial Sequence: Synthetic oligonucleotide
tgcaccccatgggcgataacgatctggatggcagcttcacccgcaccttcagcctgcgcgacggcggctactacagctccgtggtggaca

SEQ ID NO: 358 - DNA, 60 bp, Artificial Sequence
  Description of Artificial Sequence: Synthetic oligonucleotide
tgcaccccatgggcgataacgatctggatggcagcttcacccgcaccttcagcctgcgcg

SEQ ID NO: 359 - DNA, 21 bp, Artificial Sequence
  Description of Artificial Sequence: Synthetic oligonucleotide
gctgccatccagatcgttatc

SEQ ID NO: 360 - DNA, 21 bp, Artificial Sequence
  Description of Artificial Sequence: Synthetic oligonucleotide
gctgccatccagatcgttatc

SEQ ID NO: 361 - RNA, 21 nt, Artificial Sequence
  Description of Artificial Sequence: Synthetic oligonucleotide
gcugccauccagaucguuauc

SEQ ID NO: 362 - DNA, 20 bp, Artificial Sequence
  Description of Artificial Sequence: Synthetic oligonucleotide
cccgaatctctatcgtgcgg

SEQ ID NO: 363 - DNA, 21 bp, Artificial Sequence
  Description of Artificial Sequence: Synthetic oligonucleotide
gctgccatccagatcgttatc

SEQ ID NO: 364 - DNA, 20 bp, Artificial Sequence
  Description of Artificial Sequence: Synthetic oligonucleotide
gctgccatccagatcgttat

SEQ ID NO: 365 - DNA, 19 bp, Artificial Sequence
  Description of Artificial Sequence: Synthetic oligonucleotide
gctgccatccagatcgtta

SEQ ID NO: 366 - DNA, 18 bp, Artificial Sequence
  Description of Artificial Sequence: Synthetic oligonucleotide
gctgccatccagatcgtt

SEQ ID NO: 367 - DNA, 17 bp, Artificial Sequence
  Description of Artificial Sequence: Synthetic oligonucleotide
gctgccatccagatcgt

SEQ ID NO: 368 - DNA, 16 bp, Artificial Sequence
  Description of Artificial Sequence: Synthetic oligonucleotide
gctgccatccagatcg

SEQ ID NO: 369 - DNA, 15 bp, Artificial Sequence
  Description of Artificial Sequence: Synthetic oligonucleotide
gctgccatccagatc

SEQ ID NO: 370 - DNA, 14 bp, Artificial Sequence
  Description of Artificial Sequence: Synthetic oligonucleotide
gctgccatccagat

SEQ ID NO: 371 - DNA, 13 bp, Artificial Sequence
  Description of Artificial Sequence: Synthetic oligonucleotide
gctgccatccaga

SEQ ID NO: 372 - DNA, 21 bp, Artificial Sequence
  Description of Artificial Sequence: Synthetic oligonucleotide
ctattaatttcccctcgtcaa

SEQ ID NO: 373 - DNA, 21 bp, Artificial Sequence
  Description of Artificial Sequence: Synthetic oligonucleotide
tctcacttgataaccttattt

SEQ ID NO: 374 - DNA, 21 bp, Artificial Sequence
  Description of Artificial Sequence: Synthetic oligonucleotide
gatcgcagtggtgagtaacca

SEQ ID NO: 375 - DNA, 21 bp, Artificial Sequence
  Description of Artificial Sequence: Synthetic oligonucleotide
ggaagcccgatgcgccagagt

SEQ ID NO: 376 - DNA, 21 bp, Artificial Sequence
  Description of Artificial Sequence: Synthetic oligonucleotide
cctgatgatgcatggttactc

SEQ ID NO: 377 - DNA, 21 bp, Artificial Sequence
  Description of Artificial Sequence: Synthetic oligonucleotide
ggctggcgcggtatggtcggc

SEQ ID NO: 378 - DNA, 120 bp, Artificial Sequence
  Description of Artificial Sequence: Synthetic polynucleotide
acaaacagtcctgagcaaagatccaaatgaaaaagacgttggtggtggcggatcagaaggaggcggtagcggccctggttcgggaggggaaggttctgctgggggagggagcgctggcgg

SEQ ID NO: 379 - DNA, 120 bp, Artificial Sequence
  Description of Artificial Sequence: Synthetic polynucleotide
ccgccagcgctccctcccccagcagaaccttcccctcccgaaccagggccgctaccgcctccttctgatccgccaccaccaacgtctttttcatttggatctttgctcaggactgtttgt

SEQ ID NO: 380 - protein, 5 aa, Artificial Sequence
  Description of Artificial Sequence: Synthetic peptide
  MOD_RES (3)..(3): Any amino acid
RRXRR

SEQ ID NO: 381 - protein, 6 aa, Artificial Sequence
  Description of Artificial Sequence: Synthetic peptide
GSGSGS

SEQ ID NO: 382 - DNA, 25 bp, Artificial Sequence
  Description of Artificial Sequence: Synthetic primer
gtaataaaatgctcagcacagaata

SEQ ID NO: 383 - DNA, 24 bp, Artificial Sequence
  Description of Artificial Sequence: Synthetic primer
gagaaaaatatcaccagctcatct

SEQ ID NO: 384 - DNA, 6346 bp, Artificial Sequence
  Description of Artificial Sequence: Synthetic polynucleotide
tactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatataccatgaaacatcaccatcaccatcacaacactagtagcaattccatgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaactagtggatctggtggtggtggcggatggatgagcgagaatctttattttcagggcgccatggctggcaaggcacacaggctgagtgctgaggaacgggaccagctgctgccaaacctgcgggccgtggggtggaatgaactggaaggccgagatgccatcttcaaacagttccattttaaagacttcaacagggcttttggcttcatgacaagagtcgccctgcaggctgaaaagctggaccaccatcccgagtggtttaacgtgtacaacaaggtccatatcaccttgagcacccacgaatgtgccggtctttctgaacgggatataaacctggccagcttcatcgaacaagttgccgtgtctatgacataggtaccggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggt

SEQ ID NO: 385 - protein, 183 aa, Francisella tularensis
LKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKIC

SEQ ID NO: 386 - protein, 165 aa, Paramecium tetraurelia
ELPFTDQPTMICGMDVYHSTGKAKKSMLSFVSTEDEFFSKYMTQSIEMETGVEFSFSLCPVLVKSLQSFCGDRNGPLPSRIIIFRDGVSNSQAKTVIETEVAQFRQAIEQVKTEKNSDKPIKLIVLSVNKKVGAKFYAGERNLDNPPQGTLIDTEISNGKDDYYL

SEQ ID NO: 387 - protein, 158 aa, Entamoeba dispar
IDSGFSDGMTVGIDVISAGKDREIVAIVSSVDKSFTVYKKSSVVEKKGLHTAGIHIGEFMKKALESYTEYNGSHPKKVIIYRGSANTGDLKNIQQGELVEVKKAIAEYDQTIQFIYITVNNKHDMKFFSKDGNNFINPLPGTVITQGVTKTDLFQFYL

SEQ ID NO: 388 - protein, 187 aa, Arabidopsis thaliana
SRRIPLVSDRPTIIFGADVTHPHPGEDSSPSIAAVVASQDWPEITKYAGLVCAQAHRQELIQDLFKEWKDPQKGVVTGGMIKELLIAFRRSTGHKPLRIIFYRDGVSEGQFYQVLLYELDAIRKACASLEAGYQPPVTFVVVQKRHHTRLFAQNHNDRHSVDRSGNILPGTVVDSKICHPTEFDFYL

SEQ ID NO: 389 - protein, 143 aa, Thermus thermophilus
SGAYPAELAVGFDAGGRESFRFGGAACAVGGDGGHLLWTLPEAQAGERIPQEVVWDLLEETLWAFRRKAGRLPSRVLLLRDGRVPQDEFALALEALAREGIAYDLVSVRKSGGGRVYPVQGRLADGLYVPLEDKTFLLLTVHR

SEQ ID NO: 390 - protein, 143 aa, Thermus thermophilus
SGAYPAELAVGFDAGGRESFRFGGAACAVGGDGGHLLWTLPEAQAGERIPQEVVWDLLEETLWAFRRKAGRLPSRVLLLRDGRVPQDEFALALEALAREGIPYDLVSVRKSGGGRVYPVQGRLADGLYVPLEDRTFLLLTVHR

SEQ ID NO: 391 - protein, 177 aa, Rhodobacter capsulatus
HDKAINDELVVGMGLAELSGSRTEKRQRFVGITTVFAGDGSYLLGNVSKECEYEGYSDAIRESMTGILRELKKRNNWRPGDTVRVVFHAHRPLKRVDVASIVFECTREIGSDQNIQMAFVTVSHDHPFVLIDRSERGLEAYKGSTARKGVFAPPRGAISRVGRLTRLLAVNSPQLIK

SEQ ID NO: 392 - protein, 141 aa, Marinitoga piezophila
KMEDKEKNLYIGIDLSHDTYARKTNLCIAAVDNTGDILYIGKHKNLELNEKMNLDILEKEYIKAFEKYIEKFNVSPENVFILRDGRFIEDIEIIKNFISYNDTKYTLVEVNKNTNINSYDDLKEWIIKLDENTYIYYPKTF

SEQ ID NO: 393 - protein, 143 aa, Aquifex aeolicus
EIEGKVDAFVGIDISRITRDGKTVNAVAFTKIFNSKGELVRYYLTSYPAFGEKLTEKAIGDVFSLLEKLGFKKGSKIVVHRDGRLYRDEVAAFKKYGELYGYSLELLEIIKRNNPRFFSNEKFIKGYFYKLSEDSVILATYNQ

SEQ ID NO: 394 - protein, 143 aa, Thermus thermophilus
SGAYPAELAVGFDAGGRESFRFGGAACAVGGDGGHLLWTLPEAQAGERIPQEVVWDLLEETLWAFRRKAGRLPSRVLLLRDGRVPQDEFALALEALAREGIAYDLVSVRKSGGGRVYPVQGRLADGLYVPLEDRTFLLLTVHR

SEQ ID NO: 395 - protein, 143 aa, Thermus thermophilus; identical to SEQ ID NO: 389

SEQ ID NO: 396 - protein, 170 aa, Homo sapiens
QGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYL

SEQ ID NO: 397 - protein, 187 aa, Oryza sativa
SRRIPLVTDRPTIIFGADVTHPHPGEDSSPSIAAVVASQDWPEVTKYAGLVSAQSHRQELIDDLYNITHDPHRGPICGGMVRELLISFKRSTGQKPQRIIFYRDGVSEGQFYQVLLHELDAIRKACASLEANYQPQVTFIVVQKRHHTRLFAHNHNDQNSVDRSGNILPGTVVDSKICHPTEFDFFL

SEQ ID NO: 398 - protein, 140 aa, Pyrococcus furiosus
DYRFNYDYIIGIDVAPMKRSEGYIGGSAVMFDSQGYIRKIVPIKIGEQRGESVDMNEFFKEMVDKFKEFNIKLDNKKILLLRDGRITNNEEKGLKYISEMFDIEVVTMDVIKNHPVRAFANMKMYFNLGGAIYLIPHKLK

SEQ ID NO: 399 - protein, 137 aa, Methanocaldococcus jannaschii
DSKTPYDYIMGLDTGLGIFGNHRVGGCTVVYDSEGKIRRIQPIETPAPGERLHLPYVIEYLENKANIDMENKNILFLRDGFIQNSERNDLKEISKELNSNIEVISIRKNNKYKVFTSDYRIGSVFGNDGIFLPHKTP

SEQ ID NO: 400 - protein, 140 aa, Pyrococcus furiosus
DYRFNYDYIIGIDVAPMKRSEGYIGGSAVMFDSQGYIRKIVPIKIGEQRGESVDMNEFFKEMVDKFKEFNIKLDNKKILLLRDGRITNNEEEGLKYISEMFDIEVVTMDVIKNHPVRAFANMKMYFNLGGAIYLIPHKLK

SEQ ID NO: 401 - protein, 158 aa, Archaeoglobus fulgidus
VDPEKGSDIIIGTGATRIDNVNLFCFAMVFKKDGTMLWNEISPIVTSSEYLTYLKSTIKKVVYGFKKSNPDWDVEKLTLHVSGKRPKMKDGETKILKETVEELKKQEMVSRDVKYAILHLNETHPFWVMGDPNNRFHPYEGTKVKLSSKRYLLTLLQP

SEQ ID NO: 402 - protein, 158 aa, Archaeoglobus fulgidus; identical to SEQ ID NO: 401

SEQ ID NO: 403 - protein, 158 aa, Natronobacterium gregoryi
HAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEY

SEQ ID NO: 404 - protein, 159 aa, Drosophila melanogaster
LPLSGLMTIGFDIAKSTRDRKRAYGALIASMDLQQNSTYFSTVTECSAFDVLANTLWPMIAKALRQYQHEHRKLPSRIVFYRDGVSSGSLKQLFEFEVKDIIEKLKTEYARVQLSPPQLAYIVVTRSMNTRFFLNGQNPPPGTIVDDVITLPERYDFYL

SEQ ID NO: 405 - protein, 171 aa, Caenorhabditis elegans
IPLKSTMIVGYDLYHDSTLKGKTVGACVSTTSNDFTQFYSQTRPHENPTQLGNNLTHFVRKSLKQYYDNNDKTLPSRLILYRDGAGDGQIPYIKNTEVKLVRDACDAVTDKAAELSNKVQEKIKLAFIIVTKRVNMRILKQGSSSKSAINPQPGTVVDTTVTRPERMDFYL

SEQ ID NO: 406 - protein, 159 aa, Homo sapiens
IPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFI

SEQ ID NO: 407 - DNA, 20 bp, Artificial Sequence
  Description of Artificial Sequence: Synthetic oligonucleotide
ggtggcggatcagaaggagg

SEQ ID NO: 408 - DNA, 94 bp, Artificial Sequence
  Description of Artificial Sequence: Synthetic oligonucleotide
gacgttggtggtggcggatcagaaggaggcggtagcgggccctggttcgggaggggaaggttctgctgggggagggagcgctggcggggggtct

SEQ ID NO: 409 - DNA, 20 bp, Artificial Sequence
  Description of Artificial Sequence: Synthetic oligonucleotide
gatcagaaggaggcggtagc

SEQ ID NO: 410 - DNA, 94 bp, Artificial Sequence; identical to SEQ ID NO: 408
  Description of Artificial Sequence: Synthetic oligonucleotide

SEQ ID NO: 411 - DNA, 20 bp, Artificial Sequence
  Description of Artificial Sequence: Synthetic oligonucleotide
gatccaaatgaaaaagacgt

SEQ ID NO: 412 - DNA, 20 bp, Artificial Sequence
  Description of Artificial Sequence: Synthetic oligonucleotide
tctgctgggggagggagcgc

SEQ ID NO: 413 - DNA, 119 bp, Artificial Sequence
  Description of Artificial Sequence: Synthetic polynucleotide
cctgagcaaagatccaaatgaaaaagacgttggtggtggcggatcagaaggaggcggtagcgggccctggttcgggaggggaaggttctgctgggggagggagcgctggcggggggtct

SEQ ID NO: 414 - DNA, 20 bp, Artificial Sequence
  Description of Artificial Sequence: Synthetic oligonucleotide
tttcatttggatctttgctc

What is claimed is:

1. A nucleic acid editing system comprising:
 (i) an Argonaute polypeptide from a mesophilic organism;
 (ii) a guide nucleic acid; and
 (iii) a nucleic acid unwinding agent,
 wherein upon contacting a target nucleic acid with said nucleic acid editing system at a mesophilic temperature, said system cleaves the target nucleic acid.

2. The nucleic acid editing system of claim 1, wherein said guide nucleic acid is a guide DNA or a guide RNA.

3. The nucleic acid editing system of claim 1, wherein said target nucleic acid is a double-stranded DNA (dsDNA) or a single-stranded DNA (ssDNA).

4. The nucleic acid editing system of claim 1, wherein said Argonaute polypeptide generates a double-strand break or a single-strand break in said target nucleic acid.

5. The nucleic acid editing system of claim 1, wherein said target nucleic acid is of eukaryotic origin.

6. The nucleic acid editing system of claim 1, wherein said Argonaute polypeptide cleaves said target nucleic acid at a temperature from about 19° C. to about 40° C.

7. The nucleic acid editing system of claim 1, wherein said Argonaute polypeptide cleaves said target nucleic acid at about 37° C.

8. The nucleic acid editing system of claim 1, wherein said Argonaute polypeptide is from a *Clostridium*.

9. The nucleic acid editing system of claim 1, wherein said Argonaute polypeptide is from an organism selected from the group consisting of: *Paenibacillus borealis, Deinococcus* sp. YIM 77859, *Calothrix* sp. PCC 7103, *Clostridiales bacterium* NK3B98, *Thermosynechococcus elongatus* BP-1, *Hyphomonas* sp. T16B2, *Chroococcidiopsis thermalis, Clostridium disporicum, Rhodopirellula maiorica* SM1, *Clostridium perfringens, Clostridium saudiense, Clostridium bolteae, Clostridium sartagoforme,* and *Clostridium perfringens.*

10. A method of editing a target nucleic acid, the method comprising:
contacting a target nucleic acid with the nucleic acid editing system of claim 1.

11. The method of claim 10, wherein said guide nucleic acid is a guide DNA or a guide RNA.

12. The method of claim 10, wherein said target nucleic acid is a double stranded DNA (dsDNA) or a single-stranded DNA (ssDNA).

13. The method of claim 10, wherein said Argonaute polypeptide generates a double-strand break or a single-strand break in said target nucleic acid.

14. The method of claim 10, wherein said Argonaute polypeptide cleaves said target nucleic acid at a temperature from about 19° C. to about 40° C.

15. The method of claim 10, wherein said Argonaute polypeptide cleaves said target nucleic acid at about 37° C.

16. The method of claim 10, wherein said Argonaute polypeptide is from a *Clostridium*.

17. The method of claim 10, wherein said Argonaute polypeptide is from an organism selected from the group consisting of: *Paenibacillus borealis, Deinococcus* sp. YIM 77859, *Calothrix* sp. PCC 7103, *Clostridiales bacterium* NK3B98, *Thermosynechococcus elongatus* BP-1, *Hyphomonas* sp. T16B2, *Chroococcidiopsis thermalis, Clostridium disporicum, Rhodopirellula maiorica* SM1, *Clostridium* sp., *Clostridium perfringens, Clostridium saudiense, Clostridium bolteae, Clostridium sartagoforme,* and *Clostridium perfringens.*

* * * * *